(12) United States Patent
Baidyaroy et al.

(10) Patent No.: US 8,715,996 B2
(45) Date of Patent: May 6, 2014

(54) BETA-GLUCOSIDASE VARIANT ENZYMES AND RELATED POLYNUCLEOTIDES

(75) Inventors: Dipnath Baidyaroy, Fremont, CA (US); Louis Clark, San Francisco, CA (US); Lisa M. Newman, San Jose, CA (US); Charlene Ching, San Jose, CA (US)

(73) Assignee: Codexis, Inc., Redwood City, CA (US)

( * ) Notice: Subject to any disclaimer, the term of this patent is extended or adjusted under 35 U.S.C. 154(b) by 184 days.

(21) Appl. No.: 13/201,915

(22) PCT Filed: Feb. 26, 2010

(86) PCT No.: PCT/US2010/025683
§ 371 (c)(1),
(2), (4) Date: Sep. 28, 2011

(87) PCT Pub. No.: WO2010/099500
PCT Pub. Date: Sep. 2, 2010

(65) Prior Publication Data
US 2012/0015408 A1  Jan. 19, 2012

Related U.S. Application Data

(60) Provisional application No. 61/155,751, filed on Feb. 26, 2009.

(51) Int. Cl.
*C12N 9/38* (2006.01)
*A61K 38/00* (2006.01)

(52) U.S. Cl.
USPC ........... 435/207; 530/808; 530/530; 435/440; 435/6.15

(58) Field of Classification Search
CPC ............................ C12N 9/2445; C12N 9/2471
See application file for complete search history.

(56) References Cited

U.S. PATENT DOCUMENTS

| | | |
|---|---|---|
| 4,486,553 A | 12/1984 | Wesch |
| 4,683,202 A | 7/1987 | Mullis |
| 5,426,039 A | 6/1995 | Wallace et al. |
| 6,117,679 A | 9/2000 | Stemmer |
| 6,376,246 B1 | 4/2002 | Crameri et al. |
| 6,586,182 B1 | 7/2003 | Patten et al. |
| 7,629,157 B2 | 12/2009 | Davis et al. |
| 7,783,428 B2 | 8/2010 | Gustafsson et al. |
| 2004/0091469 A1 | 5/2004 | Fukasawa et al. |
| 2004/0253702 A1 | 12/2004 | Fidantsef et al. |
| 2005/0244878 A1 | 11/2005 | Dunn-Coleman et al. |
| 2008/0051559 A1* | 2/2008 | Craik et al. .................. 530/350 |
| 2008/0220990 A1 | 9/2008 | Fox |
| 2008/0233613 A1 | 9/2008 | Harris et al. |
| 2009/0312196 A1 | 12/2009 | Colbeck et al. |
| 2012/0040349 A1* | 2/2012 | Von Lode et al. ........... 435/6.11 |

FOREIGN PATENT DOCUMENTS

| | | |
|---|---|---|
| EP | 0137280 | 3/1992 |
| WO | 95/22625 A1 | 8/1995 |
| WO | 97/20078 A1 | 6/1997 |
| WO | 97/35966 A1 | 10/1997 |
| WO | 98/27230 A1 | 6/1998 |
| WO | 01/75767 A2 | 10/2001 |
| WO | 03/075129 A2 | 9/2003 |
| WO | WO 03072717 A2 * | 9/2003 |
| WO | WO 2007044043 A2 * | 4/2007 |
| WO | 2008/042876 A2 | 4/2008 |

OTHER PUBLICATIONS

Cairns et al. (2000) Sequence and expression of Thai Rosewood beta-glucosidase/beta-fucosidase, a family 1 glycosyl hydrolase glycoprotein, J. Biochem., vol. 128, pp. 999-1008.*
SEQ Align WO03072717 (2013) pp. 1-2.*
SEQ Align WO 2007044043 (2013) pp. 1-2.*
Zhang et al. (1996) An analysis of base frequencies in the anti-sense strands corresponding to the 180 human protein coding sequences, Amino acids, vol. 10, issue 3, pp. 253-262.*
SEQ Align 100 (2013) pp. 1-2.*
Adams, S.P., et al., "Hindered dialkylamino nucleoside phosphite reagents in the synthesis of two DNA 51-mers," J. Am. Chem. Soc., 105:661 (1983).
Altschul, S.F., et al., "Gapped BLAST and PSI-BLAST: a new generation of protein database search programs," Nucleic Acids Res., 25(17):3389-3402 (1997).
Arnheim, N., et al., "Polymerase Chain Reaction," C&EN, pp. 36-47 (1990).
Barringer, K.J., et al., "Blunt-end and single-strand ligations by *Escherichia coli* ligase: influence on an in vitro amplification scheme," Gene, 89:117-122 (1990).
Beaucage, S.L., et al., "Deoxynucleoside phosphoamidites—A new class of key intermediates for deoxypolynucleotide synthesis," Tetrahedron Letters, 22(20):1859-62 (1981).
Boel, E., et al., "Two different types of intervening sequences in the glucoamylase gene from *Aspergillus niger*," EMBO J., 3(7):1581-1585 (1984).
Botstein, D., et al., "Strategies and applications of in vitro mutagenesis," Science, 229(4719):1193-1201 (1985).
Breves, R., et al., "Genes encoding two different beta-gludosidases of Thermoa naerobacter brockii are clustered in a common operon," Appl. Environ. Microbiology, 63(10):3902-3910 (1997).

(Continued)

*Primary Examiner* — Manjunath Rao
*Assistant Examiner* — Samuel Liu
(74) *Attorney, Agent, or Firm* — Codexis, Inc.

(57) ABSTRACT

The invention provides variants of the *Thermoanaerobacter brockii* CglT beta-glucosidase that have improve beta-glucosidase activity compared to the wild type enzyme. The invention also provides polynucleotides that encode the variants, as well as methods of producing the variants, enzyme compositions comprising the variants, and methods for using the variants in industrial applications.

12 Claims, 4 Drawing Sheets

(56) References Cited

OTHER PUBLICATIONS

Brigham, J.S., et al., "Hemicellulases: Diversity and Applications," in Handbook on Bioethanol (C. Wyman ed.) pp. 119-141, Taylor and Francis, Washington DC, (1995).
Carter, P., "Site-directed mutagenesis," Biochem. J., 237:1-7 (1986).
Caruthers, M.H., et al., "Chemical Synthesis and Biological Studies on Mutated Gene-control Regions," Cold Spring Harbor Symp. Quant. Biol., 47:411-418 (1982).
Case, M.E. et al., "Efficient transformation of Neurospora crassa by utilizing hybrid plasmid DNA," Proc. Natl. Acad. Sci. USA, 76(10):5259-5263 (1979).
Cheng, S., et al., "Long PCR," Nature, 369: 684-685 (1994).
Christians, F.C., et al., "Directed evolution of thymidine kinase for AZT phosphorylation using DNA family shuffling," Nature Biotechnology, 17:259-264 (1999).
Crameri, A., et al., "DNA shuffling of a family of genes from diverse species accelerates directed evolution," Nature, 391:288-291 (1998).
Crameri, A., et al., "Improved green fluorescent protein by molecular evolution using DNA shuffling," Nature Biotechnology, 14:315-319 (1996).
Crameri, A., et al., "Molecular evolution of an arsenate detoxification pathway by DNA shuffling," Nature Biotechnology, 15:436-438 (1997).
Dale, S.J., et al., "Oligonucleotide-directed random mutagenesis using the phosphorothioate method," Methods Mol. Biol., 57:369-74 (1996).
Dayhoff, M.O., et al., "A model of evolutionary change in proteins" in "Atlas of Protein Sequence and Structure," vol. 5, Suppl. 3, pp. 345-352, Natl. Biomed. Res. Round., Washington, D.C. (1978).
Fox, R., "Directed molecular evolution by machine learning and the influence of nonlinear interactions," J. Theor. Biol. 234(2):187-199 (2005).
Fox, R., et al., "Optimizing the search algorithm for protein engineering by directed evolution," Protein Eng., 16 (8):589-597 (2003).
Guatelli, J.C., et al., "Isothermal, in vitro amplification of nucleic acids by a multienzyme reaction modeled after retroviral replication," Proc. Natl. Acad. Sci. USA, 87:1874-1878 (1990).
Heanut, A., et al., "Analysis and predictions from Escherichia coli sequences, or E. coli in silico," in Escherichia coli and Salmonella, ASM Pres, Washington D.C., pp. 2047-2066 (1987).
Henikoff, S., et al. "Amino acid substitution matrices from protein blocks," Proc. Natl. Acad. Sci. USA, 89:10915-10919 (1992).
Johnstone, I.L., et al., "Cloning an Aspergillus nidulans developmental gene by transformation," EMBO J., 4 (5):1307-1311 (1985).
Kelly, J.M., et al., "Transformation of Asoergillus niger by the amdS gene of Aspergillus nidulans," EMBO J., 4 (2):475-479 (1985).
Kinsey, J.A., et al., "Transformation of Neurospora crassa with the Cloned am (Glutamate Dehydrogenase) Gene", Molecular and Cellular Biology, 4:117-122 (1984).
Kramer, B., et al., "Different base/base mismatches are corrected with different efficiencies by the methyl-directed DNA mismatch-repair system," Cell, 38:879-887 (1984).
Kwoh, D.Y., et al., "Transcription-based amplification system and detection of amplified human immunodeficiency virus type 1 with a bead-based sandwich hybridization format," Proc. Natl. Acad. Sci. USA, 86:1173-1177 (1989).
Ladisch, M.R., et al., "Process considerations in the enzymatic hydrolysis of biomass," Enzyme Microb. Technol., 5:82 (1983).
Landegren, U., et al., "A Ligase-Mediated Gene Detection Technique," Science, 241:1077-1080 (1988).
Lemaire, M., et al., "Nucleotide Sequence of the celG Gene of Clostridium thermocellum and Characterization of Its Product, Endoglucanase CelG," J. Bact., 175(11):3353-3360 (1993).
Ling, M.M., et al., "Approaches to DNA mutagenesis: an overview," Anal. Biochem., 254(2):157-78 (1997).
Lomeli, H., et al., "Quantitative Assays Based on the Use of Replicatable Hybridization Probes," J. Clin. Chem, 35 (9): 1826-1831 (1989).
Matthes, H.W.D., et al., "Simultaneous rapid chemical synthesis of over one hundred oligonucleotides on a microscale," EMBO J., 3(4):801-05 (1984).
Minshull, J., et al., "Protein evolution by molecular breeding," Current Opinion in Chemical Biology, 3:284-290 (1999).
Nunberg, J.H., et al., "Molecular Cloning and Characterization of the Glucoamylase Gene of Aspergillus awamori," Mol. Cell Biol., 4(11):2306-2315 (1984).
Porath, J., "Immobilized metal ion affinity chromatography," Protein Expression and Purification, 3:263-281 (1992).
Ricciardelli, C., et al., "Development and characterization of primary cultures of smooth muscle cells from the fibromuscular stroma of the guinea pig prostate," In vitro Cell Dev. Biol., 25:1016-1024 (1989).
Robert, S.S., "Amplification of Nucleic Acid Sequences: The Choices Multiply," The Journal of NIH Research, 3:81-94 (1991).
Sheir-Neiss, G., et al., "Characterization of the secreted cellulases of Trichoderma reesei wild type and mutants during controlled fermentations," Appl. Microbiol. Biotechnol., 20:46-53 (1984).
Simonen, M., et al., "Protein Secretion in Bacillus Species," Microbiological Reviews, 57:109-137 (1993).
Smith, M., "In vitro mutagenesis," Ann. Rev. Genet., 19:423-462 (1985).
Sooknanan, R., et al., "NASBRA: A detection and amplification system uniquely suited for RNA," Biotechnology, 13: 563-564 (1995).
Stemmer, W.P.C., "DNA shuffling by random fragmentation and reassembly: In vitro recombination for molecular evolution," Proc. Natl. Acad. Sci., U.S.A., 91:10747-10751 (1994).
Stemmer, W.P.C., "Rapid evolution of a protein in vitro by DNA shuffling," Nature, 370:389-391 (1994).
Suurnakki, A., et al., "Trichoderma reesei cellulases and their core domains in the hydrolysis and modification of chemical pulp," Cellulose, 7:189 -209 (2004).
Tilburn, J., et al., "Transformation by integration in Asperfillus nidulans," Gene, 26:205-221 (1982).
Van Brunt, J., "Amplifying Genes: PCR and its alternatives," Biotechnology, 8:291-294 (1990).
Wells, J.A., et al., "Cassette mutagenesis: an efficient method for generation of multiple mutations at defined sites," Gene, 34:315-323 (1985).
Wilson, I.A., et al., "The structure of an antigenic determinant in a protein," Cell, 37:767-778 (1984).
Wu, D.Y., et al., "The Ligation Amplification Reaction (LAR)—Amplification of Specific DNA Sequences Using Sequential Rounds of Template-Dependent Ligation," Genomics, 4:560 (1989).
Yelton, M.M., et al., "Transformation of Aspergillus nidulans by using a trpC plasmid," Proc. Natl. Acad. Sci. USA, 81:1470-1474 (1984).
Zhang, J-H., et al., "Directed evolution of an effective fucosidase from a galactosidase by DNA shuffling and screening," Proc. Natl. Acad. Sci., U.S.A., 94:4504-4509, (1997).

* cited by examiner

ATGATTAAATTAGCCAAGTTTCCGCGTGATTTTGTGTGGGAACGGCGACATCCAGTTATCAAATCGAAGGGGCTGTTAATGAAGATGTCGTACC
CCGAGTATCTGGGATACCTTCTCTAAAACGGAGGGGAAAACTTACAAAGGTCATACAGGTGATGTCGCATGTGACCATTATCATCGCTACAAAGAG
GATGTCGAGATCTTAAAGAAATTGGAGTAAAGGCCTACCGCTTCTCGATTGCTTGGCCACGTATTTCCAGAAGAAGGCAAATACAATCCAAAA
GGCATGGATTTTTACAAGAAGTTGATCGATGAACTCCAGAAGCGCGATATTGTCCCCGCGACGATTATCACTGGGATTTACCGCAGTGGGCG
TACGATAAAGGCGGTGGCTGGTTAAATCGTGAAAGCATCAAATGGTATGTAGAATATCAACCAAACTTTTTGAGGAATTGGGTGACGCCATTCCT
CTCTGGATCACACACATAATGAACCGTGGTGTTCAAGTATTTTGAGCTATGGTGTATTGGTGAGCATGCGCCTGGCCATAAAACTATCGCGAAGCACTC
ATTGCTGCACACCATATTTTTGTTGTCGCACGTGAAGCGTGAAGCCGTGAAATATCAAAGGGTCCAAGATTGAATCACCCCTCAAT
CTCACCCCAGCGTATCCCGCCAGCGAGAAGAAGAAGATAAGTTGGCGGCAGTACGCCGAGTTGCTAACCGTTGGTTCCTCGACCCGATC
TTTCAAAGGAAAACTACCCGGAAGATATGATGGAGTTATATAGCAAGATCATCGGCGAGTTTGATTTTATCAAAGAAGGCGACTTGGAAACGATCTCT
GTCCCAAATCGACTTTTTAGGTGTTAACTATTATTATACGCGCTCCAATCGTCAAATACGATGAAGACTTCTATGCTTAAAGCCGTATACCAAATTACCTATGTAC
GGCAAACGCACCGAGATGGGGTGGGAAATTTCGCCGGAGTCATTATTATGAAGATGGGGCGCGTTCACGATGAGCGTATTGAATACATCAAAGAGCACCTTAAG
ATTACTGAAAACGGCGCTGCATTCAAAGACGAAGTTACTTCGTGGTCATTGATGGATAATTTTGAATGGGCACACGGGTATTCCAAA
CGTTTTGCATTGTTTATGTAGATTATACTACCCCAGAAACGCATCCTCAAAGATAGTGCCGTTGTGGTACAAAGAAGTGATTCTTGATGACGGCATT
GAAGACTAATGA

BETA-GLUCOSIDASE VARIANT ENZYMES AND RELATED POLYNUCLEOTIDES

This application claims the benefit, pursuant 35 U.S.C. §119(e), of U.S. Ser. No. 61/155,751, filed Feb. 26, 2009, which is incorporated herein by reference in its entirety.

FIELD OF THE INVENTION

The present invention relates inter alia, to novel β-glucosidase variants having altered properties relative to a parent β-glucosidase, the polynucleotides that encode the variants, methods of producing the variants, enzyme compositions comprising said variants, and methods for using the variants in various industrial applications.

REFERENCE TO SEQUENCE LISTING, TABLE OR COMPUTER PROGRAM

The Sequence Listing submitted concurrently herewith under 37 C.F.R. §1.821 in a computer readable form (CRF) via EFS-Web as file name cx3-003WO1_ST25.txt is incorporated herein by reference. The electronic copy of the Sequence Listing was created on Feb. 26, 2010 with a file size of 648 kilobytes.

BACKGROUND OF THE INVENTION

Cellulosic biomass is a significant renewable resource for the generation of sugars. Fermentation of these sugars can yield numerous end-products such as fuels and chemicals that are currently derived from petroleum. While the fermentation of sugars to fuels such as ethanol is relatively straightforward, the hydrolytic conversion of cellulosic biomass to fermentable sugars such as glucose is difficult because of the crystalline structure of cellulose and its close association with lignin. Ladisch, et al., *Enzyme Microb. Technol.* 5:82 (1983). Pretreatment, by means, including but not limited to, mechanical and solvent means, increases the susceptibility of cellulose to hydrolysis. Pretreatment may be followed by the enzymatic conversion of cellulose to glucose, cellobiose, cello-oligosaccharides and the like, using enzymes that specialize in breaking up the β-1-4 glycosidic bonds of cellulose. These enzymes are collectively referred to as "cellulases".

Cellulases are divided into three sub-categories of enzymes: 1,4-β-D-glucan glucanohydrolase ("endoglucanase" or "EG"); 1,4-β-D-glucan cellobiohydrolase ("exoglucanase", "cellbiohydrolase", or "CBH"); and β-D-glucoside-glucohydrolase ("β-glucosidase", "cellobiase" or "BG"). Endoglucanases randomly attack the interior parts and mainly the amorphous regions of cellulose, mostly yielding glucose, cellobiose, and cellotriose. Exoglucanases incrementally shorten the glucan molecules by binding to the glucan ends and releasing mainly cellobiose units from the ends of the cellulose polymer. β-glucosidases split the cellobiose, a water-soluble β-1,4-linked dimer of glucose, into two units of glucose.

There are several types of microorganisms that produce cellulases. These include fungi, actinomycetes, and bacteria. Cellulases from strains of the filamentous fungi *Trichoderma* sp. and *Chrysosporium* sp. have been particularly productive in hydrolyzing cellulose. *Trichoderma* sp. and other strains typically produce all three types of cellulases described above (e.g., a whole cellulase system). However, one of the major drawbacks of *Trichoderma* cellulases and other cellulases obtained from filamentous fungi is the low level of β-glucosidase activity, and this low level of activity leads to incomplete conversion of cellobiose to glucose in the cellulose hydrolysis process. Additionally, cellobiose and glucose have been reported to be inhibitors of the cellulase enzyme system; for example it is known that cellobiase is inhibited by glucose. Ait, N., et al., *J. Gen Microbiol.* 128:569-577 (1982). Poor glucose yields, whether due to deficiencies in the inherent activities of certain cellulase activities or due to the effect of end product inhibition, are impediments to commercially viable processes for producing sugars and end-products (e.g., alcohols) from biomass.

In order to maximize the hydrolysis of cellulosic substrates it would be highly desirable to develop new cellulases and particularly new β-glucosidases enzymes having altered properties as compared to a parent β-glucosidase.

SUMMARY OF THE INVENTION

The present invention has multiple aspects. The disclosure provides isolated, recombinant and/or variant β-glucosidases, polynucleotides encoding said β-glucosidases, host cells incorporating said polynucleotides, enzyme compositions comprising the same, and methods for increasing the yield of soluble sugars from the enzymatic saccharification of biomass substrates.

In one aspect, the invention relates to an isolated, recombinant and/or variant β-glucosidase polypeptide comprising an amino acid sequence that is at least 85% identical to wild type *Thermoanaerobacter brockii* β-glucosidase (herein designated "CglT") (SEQ ID NO: 2) and having at least one substitution of an amino acid at a position corresponding to position F11, N27, S34, Y47, K48, E64, I81, A82, P84, K103, R111, Y129, K131, G134, K142, K150, E153, A158, I159, H202, A205, K215, I221, T222, Y229, A231, L239, A241, D254, I256, F257, E285, T286, I291, I303, D307, W328, I330, S334, M351, Y352, L383, F389, K397, H412, T427, K429, V442, D445, D446, and/or *451 of SEQ ID NO: 2.

In some embodiments, the isolated, recombinant and/or variant β-glucosidase polypeptide comprises at least one substitution selected from the group of E64, P84, K215, K131, I303, D307 and I330, when the amino acid position is determined by alignment with SEQ ID NO: 2. In other embodiments, the isolated, recombinant and/or variant β-glucosidase polypeptide comprises at least one substitution selected from the group of E64K, P84T, K131I, K215E, I303V, and D307A, when the amino acid position is determined by alignment with SEQ ID NO: 2. In further embodiments, an isolated β-glucosidase polypeptide variant encompassed by the invention comprises an amino acid sequence that is at least about 96% identical to SEQ ID NO: 4.

In another aspect, the invention relates to polynucleotides encoding the isolated, recombinant and/or variant β-glucosidase polypeptides encompassed by the invention.

In other aspects, the invention relates to vectors comprising a DNA construct or a polynucleotide which encodes a β-glucosidase polypeptide of the invention.

In other aspects, the invention relates to host cells comprising the vectors and said polynucleotides. In some embodiments, the preferred host cells include *Bacillus* sp, *Acidothermus* sp., *Trichoderma* sp., *Aspergillus* sp., *Chrysosporium* sp., *Penicillium* sp., *Myceliophthora* sp., *Neurospora* sp., and *Fusarium* sp. In some embodiments, the recombinant host cells produce an increased level of β-glucosidase relative to a corresponding host cell under essentially the same conditions.

In additional aspects, the invention relates to methods for producing a recombinant and/or variant β-glucosidase polypeptide comprising a) introducing into a host cell a polynucleotide encoding a polypeptide which comprises an amino acid sequence that is at least 85% identical to the sequence of SEQ ID NO. 2 and having at least one substitution of an amino acid residue at a position corresponding to F11, N27, S34, Y47, K48, E64, I81, A82, P84, K103, R111, Y129, K131, G134, K142, K150, E153, A158, I159, H202, A205, K215, I221, T222, Y229, A231, L239, A241, D254, I256, F257, E285, T286, I291, I303, D307, W328, I330, S334, M351, Y352, L383, F389, K397, H412, T427, K429, V442, D445, D446, and/or *451, wherein the amino acid position is determined by alignment with SEQ ID NO: 2; b) culturing the host cell under suitable culture conditions which allows expression and production of the β-glucosidase polypeptide and c) optionally recovering the β-glucosidase polypeptide.

In yet other aspects, the invention relates to enzyme compositions comprising the β-glucosidase polypeptides encompassed by the invention and optionally mixtures of additional cellulase enzymes.

In other aspects, the invention relates to using a β-glucosidase polypeptide of the present invention or composition thereof in the conversion of a biomass substrate to soluble sugars (e.g., glucose).

These and other features of the present teachings are provided herein.

BRIEF DESCRIPTION OF THE FIGURES

FIG. 2 depicts the nucleotide sequence of SEQ ID NO:1 of the codon optimized *Thermoanaerobacter brockii* cg1T gene expressed using the pCK110900 expression vector as described in example 1.

DETAILED DESCRIPTION OF VARIOUS EMBODIMENTS

Definitions

Figure 1:
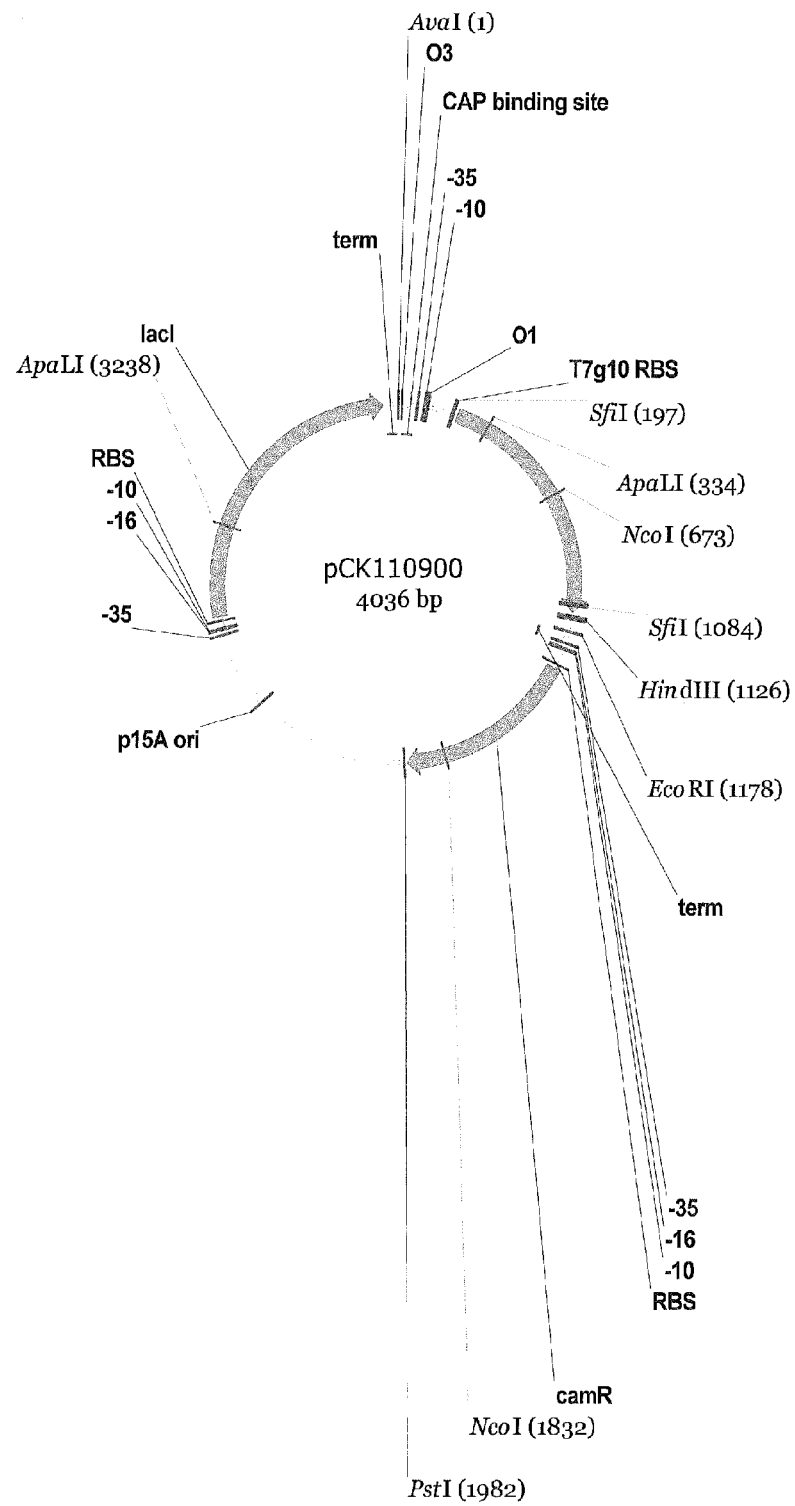
FIG. 1 is a 4036 bp expression vector (pCK110900) of the present invention comprising a P15A origin of replication (P15A ori), a CAP binding site, a lac promoter, a T7 ribosomal binding site (T7g10 RBS), and a chloramphenicol resistance gene (camR).

As used herein, the following terms are intended to have the following meanings

The term "cellulase" refers to a category of enzymes capable of hydrolyzing cellulose (β-1,4-glucan or β-D-glucosidic linkages) to shorter oligosaccharides, cellobiose and/or glucose.

The term "β-glucosidase" or "cellobiase" used interchangeably herein means a β-D-glucoside glucohydrolase which catalyzes the hydrolysis of a sugar dimer, including but not limited to cellobiose with the release of a corresponding sugar monomer. In one embodiment, a β-glucosidase is a β-glucosidase glucohydrolase having E.C. 3.2.1.21 which catalyzes the hydrolysis of cellobiose to glucose. Some of the β-glucosidases have the ability to also hydrolyze β-D-galactosides, β-L-arabinosides and/or β-D-fucosides and further some β-glucosidases can act on α-1,4-substrates such as starch. β-glucosidase activity may be measured by methods well known in the art (e.g., HPLC).

The term "β-glucosidase polypeptide" refers herein to a polypeptide having β-glucosidase activity.

The term "β-glucosidase polynucleotide" refers to a polynucleotide encoding a polypeptide having β-glucosidase activity.

"Cellulolytic activity" encompasses exoglucanase activity (CBH), endoglucanase (EG) activity and/or β-glucosidase activity.

The term "exoglucanase", "exo-cellobiohydrolase" or "CBH" refers to a group of cellulase enzymes classified as E.C. 3.2.1.91. These enzymes hydrolyze cellobiose from the reducing or non-reducing end of cellulose.

The term "endoglucanase" or "EG" refers to a group of cellulase enzymes classified as E.C. 3.2.1.4. These enzymes hydrolyze internal β-1,4 glucosidic bonds of cellulose.

As used herein, the term "isolated" refers to a nucleic acid, polynucleotide, polypeptide, protein, or other component that is partially or completely separated from components with which it is normally associated (other proteins, nucleic acids, cells, synthetic reagents, etc.).

The term "wild-type" as applied to a polypeptide (protein) means a polypeptide (protein) expressed by a naturally occurring microorganism such as bacteria or filamentous fungus found in nature.

A "variant" as used herein means an engineered β-glucosidase polypeptide or polynucleotide encoding a β-glucosidase comprising one or more modifications such as substitutions, deletions and/or truncations of one or more specific amino acid residues or of one or more specific nucleotides or codons in the polypeptide or polynucleotide.

The term "parent" β-glucosidase as used herein means a β-glucosidase to which modifications such as substitutions, deletions and/or truncations are made to produce the enzyme variants of the present invention. A parent β-glucosidase may sometimes be a reference sequence. A parent β-glucosidase may be a naturally occurring (wild type) polypeptide.

A "reference β-glucosidase sequence" refers to a defined sequence used as a basis for a sequence comparison. A reference β-glucosidase sequence may be a subset of a larger sequence. Generally a reference sequence is at least 25 amino acid residues in length, at least 50 residues in length, at least 100 residues in length, at least 150 residues in length at least 200 residues in length, at least 300 residues in length, at least 350 residues in length or the full length of the polypeptide.

A nucleic acid (such as a polynucleotide) or a polypeptide is "recombinant" when it is artificial or engineered, or derived from an artificial or engineered protein or nucleic acid. For example, a polynucleotide that is inserted into a vector or any other heterologous location, e.g., in a genome of a recombinant organism, such that it is not associated with nucleotide sequences that normally flank the polynucleotide as it is found in nature is a recombinant polynucleotide. A protein expressed in vitro or in vivo from a recombinant polynucleotide is an example of a recombinant polypeptide. Likewise, a polynucleotide sequence that does not appear in nature, for example a variant of a naturally occurring gene, is recombinant.

An "improved property" refers to a β-glucosidase polypeptide that exhibits an improvement in any property as compared to the wild type *Thermoanaerobacter brockii* β-glucosidase ("CglT") (SEQ ID NO: 2) or a reference β-glucosidase sequence. Improved properties may include increased protein expression, thermostability, pH activity, pH stability, product specificity, increased specific activity, substrate specificity, increased resistance to substrate or end-product inhibition, altered temperature profile, and chemical stability.

The term "improved thermoactivity" as used herein means a variant displaying an increase in the rate of hydrolysis and at the same time decreasing the time required and/or decreasing the amount of enzyme concentration required for hydrolysis. Alternatively a variant with a reduced thermal activity will catalyze a hydrolysis reaction at a temperature lower than the temperature optimum of the parent as defined by the temperature dependent activity profile of the parent.

The phrase "a corresponding microorganism" or "corresponding host cell" means that the corresponding host cell or microorganism has not been transformed with a polynucleotide encoding a β-glucosidase of the invention but that the corresponding host cell or microorganism and the transformed or recombinant host cell or microorganism are cultured under essentially the same culture conditions.

The terms "percent identity," "% identity," "percent identical," and "% identical" are used interchangeably herein to refer to the percent amino acid sequence identity that is obtained by ClustalW analysis (version W 1.8 available from European Bioinformatics Institute, Cambridge, UK), counting the number of identical matches in the alignment and dividing such number of identical matches by the length of the reference sequence, and using the following default ClustalW parameters to achieve slow/accurate pairwise optimal alignments—Gap Open Penalty: 10; Gap Extension Penalty: 0.10; Protein weight matrix: Gonnet series; DNA weight matrix: IUB; Toggle Slow/Fast pairwise alignments=SLOW or FULL Alignment.

Two sequences are "optimally aligned" when they are aligned for similarity scoring using a defined amino acid substitution matrix (e.g., BLOSUM62), gap existence penalty and gap extension penalty so as to arrive at the highest score possible for that pair of sequences. Amino acid substitution matrices and their use in quantifying the similarity between two sequences are well-known in the art. See e.g., Dayhoff et al. (1978), "A model of evolutionary change in proteins"; "Atlas of Protein Sequence and Structure," Vol. 5, Suppl. 3 (Ed. M. O. Dayhoff), pp. 345-352, *Natl. Biomed. Res. Round.*, Washington, D.C.; and Henikoff et al. (1992) *Proc. Natl. Acad. Sci. USA*, 89:10915-10919, both of which are incorporated herein by reference. The BLOSUM62 matrix is often used as a default scoring substitution matrix in sequence alignment protocols such as Gapped BLAST 2.0. The gap existence penalty is imposed for the introduction of a single amino acid gap in one of the aligned sequences, and the gap extension penalty is imposed for each additional empty amino acid position inserted into an already opened gap. The alignment is defined by the amino acid position of each sequence at which the alignment begins and ends, and optionally by the insertion of a gap or multiple gaps in one or both sequences so as to arrive at the highest possible score. While optimal alignment and scoring can be accomplished manually, the process is facilitated by the use of a computer-implemented alignment algorithm, e.g., gapped BLAST 2.0, described in Altschul, et al. (1997) *Nucleic Acids Res.*, 25:3389-3402 (incorporated herein by reference), and made available to the public at the National Center for Biotechnology Information Website. Optimal alignments, including multiple alignments can be prepared using readily available programs such as PSI-BLAST, which is described by Altschul, et al. (1997) *Nucleic Acids Res.*, 25:3389-3402 and which is incorporated herein by reference.

"Corresponding to", "reference to" "or relative to" when used in the context of the numbering of a given amino acid or polynucleotide sequence refers to the numbering of the residues of a specified reference sequence when the given amino acid or polynucleotide sequence is compared to the reference sequence.

The "position" is denoted by a number that sequentially identifies each amino acid in the reference sequence based on its position relative to the N-terminus. Owing to deletions, insertions, truncations, fusions, and the like that must be taken into account when determining an optimal alignment, in general the amino acid residue number in a test sequence determined by simply counting from the N-terminal will not necessarily be the same as the number of its corresponding position in the reference sequence. For example, in a case where there is a deletion in an aligned test sequence, there will be no amino acid that corresponds to a position in the reference sequence at the site of deletion. Where there is an insertion in an aligned reference sequence, that insertion will not correspond to any amino acid position in the reference sequence. In the case of truncations or fusions there can be stretches of amino acids in either the reference or aligned sequence that do not correspond to any amino acid in the corresponding sequence.

Nucleic acids "hybridize" when they associate, typically in solution. Nucleic acids hybridize due to a variety of well-characterized physico-chemical forces, such as hydrogen bonding, solvent exclusion, base stacking and the like. As used herein, the term "stringent hybridization wash conditions" in the context of nucleic acid hybridization experiments, such as Southern and Northern hybridizations, are sequence dependent, and are different under different environmental parameters. An extensive guide to the hybridization of nucleic acids is found in Tijssen (1993) "Laboratory Techniques in biochemistry and Molecular Biology-Hybridization with Nucleic Acid Probes," Part I, Chapter 2 (Elsevier, New York), which is incorporated herein by reference.

For purposes of the present invention, "highly stringent" (or "high stringency") hybridization and wash conditions are generally selected to be about 5° C. or less lower than the thermal melting point ($T_m$) for the specific sequence at a defined ionic strength and pH (as noted below, highly stringent conditions can also be referred to in comparative terms). The $T_m$ is the temperature (under defined ionic strength and pH) at which 50% of the test sequence hybridizes to a perfectly matched probe. Very stringent conditions are selected to be equal to the $T_m$ for a particular probe.

The $T_m$ of a nucleic acid duplex indicates the temperature at which the duplex is 50% denatured under the given conditions and it represents a direct measure of the stability of the nucleic acid hybrid. Thus, the $T_m$ corresponds to the temperature corresponding to the midpoint in transition from helix to random coil; it depends on length, nucleotide composition, and ionic strength for long stretches of nucleotides.

After hybridization, unhybridized nucleic acid material can be removed by a series of washes, the stringency of which can be adjusted depending upon the desired results. Low stringency washing conditions (e.g., using higher salt and lower temperature) increase sensitivity, but can produce nonspecific hybridization signals and high background signals. Higher stringency conditions (e.g., using lower salt and higher temperature that is closer to the hybridization temperature) lowers the background signal, typically with only the specific signal remaining (e.g., increases specificity). See Rapley, R. and Walker, J. M. Eds., "Molecular Biomethods Handbook" (Humana Press, Inc. 1998), which is incorporated herein by reference.

The $T_m$ of a DNA-DNA duplex can be estimated using Equation 1 as follows:

$T_m$ (° C.)=81.5° C.+16.6 ($\log_{10}$M)+0.41 (% G+C)−0.72 (% f)−500/n, where M is the molarity of the monovalent cations (usually Na$^+$), (% G+C) is the percentage of guanosine (G) and cystosine (C) nucleotides, (% f) is the percentage of formamide and n is the number of nucleotide bases (e.g., length) of the hybrid. See id.

The $T_m$ of an RNA-DNA duplex can be estimated by using Equation 2 as follows: $T_m$ (° C.)=79.8° C.+18.5 ($\log_{10}$M)+ 0.58 (% G+C)−11.8(% G+C)$^2$−0.56 (% f)−820/n, where M is the molarity of the monovalent cations (usually Na+), (% G+C) is the percentage of guanosine (G) and cystosine (C) nucleotides, (% f) is the percentage of formamide and n is the number of nucleotide bases (e.g., length) of the hybrid. Id.

Equations 1 and 2 are typically accurate only for hybrid duplexes longer than about 100-200 nucleotides. Id.

The Tm of nucleic acid sequences shorter than 50 nucleotides can be calculated as follows: $T_m$ (° C.)=4(G+C)+2(A+T), where A (adenine), C, T (thymine), and G are the numbers of the corresponding nucleotides.

An example of stringent hybridization conditions for hybridization of complementary nucleic acids which have more than 100 complementary residues on a filter in a Southern or Northern blot is 50% formamide with 1 mg of heparin at 42° C., with the hybridization being carried out overnight. An example of stringent wash conditions is a 0.2×SSC wash at 65° C. for 15 minutes (see Sambrook, et al., Molecular Cloning—A Laboratory Manual" (1989) Cold Spring Harbor Laboratory (Cold Spring Harbor, N.Y.), which is incorporated herein by reference, for a description of SSC buffer). Often the high stringency wash is preceded by a low stringency wash to remove background probe signal. An example low stringency wash is 2×SSC at 40° C. for 15 minutes.

In general, a signal to noise ratio of 2.5×-5× (or higher) than that observed for an unrelated probe in the particular hybridization assay indicates detection of a specific hybridization. Detection of at least stringent hybridization between two sequences in the context of the present invention indicates relatively strong structural similarity or homology to, e.g., the nucleic acids of the present invention provided in the sequence listings herein.

As noted, "highly stringent" conditions are selected to be about 5° C. or less lower than the thermal melting point ($T_m$) for the specific sequence at a defined ionic strength and pH. Target sequences that are closely related or identical to the nucleotide sequence of interest (e.g., "probe") can be identified under highly stringent conditions. Lower stringency conditions are appropriate for sequences that are less complementary.

Stringent hybridization (as well as highly stringent, ultra-high stringency, or ultra-ultra high stringency hybridization conditions) and wash conditions can be readily determined empirically for any test nucleic acid. For example, in determining highly stringent hybridization and wash conditions, the hybridization and wash conditions are gradually increased (e.g., by increasing temperature, decreasing salt concentration, increasing detergent concentration and/or increasing the concentration of organic solvents, such as formamide, in the hybridization or wash), until a selected set of criteria are met. For example, the stringency of hybridization and wash conditions is gradually increased until a probe corresponding to SEQ ID NO: 1 or complementary sequence thereof, binds to a perfectly matched complementary target.

A test nucleic acid is said to specifically hybridize to a probe nucleic acid when it hybridizes at least ½ as well to the probe as to the perfectly matched complementary target, e.g., with a signal to noise ratio at least ½ as high as hybridization of the probe to the target under conditions in which the perfectly matched probe binds to the perfectly matched complementary target.

Ultra high-stringency hybridization and wash conditions are those in which the stringency of hybridization and wash conditions are increased until the signal to noise ratio for binding of the probe to the perfectly matched complementary target nucleic acid is at least 10×. A target nucleic acid which hybridizes to a probe under such conditions, with a signal to noise ratio of at least ½ that of the perfectly matched complementary target nucleic acid is said to bind to the probe under ultra-high stringency conditions.

Similarly, even higher levels of stringency can be determined by gradually increasing the stringency of hybridization and/or wash conditions of the relevant hybridization assay. For example, those in which the stringency of hybridization and wash conditions are increased until the signal to noise ratio for binding of the probe to the perfectly matched complementary target nucleic acid is at least 10×, 20×, 50×, 100×, or 500×. A target nucleic acid which hybridizes to a probe under such conditions, with a signal to noise ratio of at least ½ that of the perfectly matched complementary target nucleic acid is said to bind to the probe under ultra-ultra-high stringency conditions.

In describing the various variants of the present invention, the nomenclature described below is adapted for ease of reference. In all cases the accepted IUPAC single letter or triple letter amino acid abbreviations are employed. For amino acid substitutions the following nomenclature is used: [Original amino acid, position, substituted amino acid]. Accordingly, the substitution of serine with glycine at position 34 is designated "Ser34Gly" or "S34G" and the substitution of histidine with either tryptophan, leucine, phenylalanine or valine at position 412 is designated "His412Trp/Leu/PheNal" or "H412W/L/FN".

The term "culturing" or "cultivation" refers to growing a population of microbial cells under suitable conditions in a liquid or solid medium. In some embodiments, culturing refers to fermentative bioconversion of a cellulosic substrate to an end-product.

The term "contacting" refers to the placing of a respective enzyme in sufficiently close proximity to a respective substrate to enable the enzyme to convert the substrate to a product. Those skilled in the art will recognize that mixing a solution of the enzyme with the respective substrate will effect contacting.

As used herein the term "transformed" or "transformation" used in reference to a cell means a cell has a non-native nucleic acid sequence integrated into its genome or as an episomal plasmid that is maintained through multiple generations.

The term "introduced" in the context of inserting a nucleic acid sequence into a cell means transfected, transduced or transformed (collectively "transformed") and includes reference to the incorporation of a nucleic acid sequence into a eukaryotic or prokaryotic cell wherein the nucleic acid is incorporated into the genome of the cell.

As used herein "a", "an", and "the" include plural references unless the context clearly dictates otherwise.

The term "comprising" and its cognates are used in their inclusive sense; that is, equivalent to the term "including" and its corresponding cognates.

β-Glucosidase Polypeptide Variants

The present invention provides novel enzymes that are variants of a parent or wild type cellobiase enzyme, which has β-glucosidase activity.

In some embodiments the parent or wild type β-glucosidase enzyme is a sequence having at least 85% sequence identity, at least 90% sequence identity, at least 93% sequence identity, at least 95% sequence identity, at least 98% sequence identity or at least 99% sequence identity to SEQ ID NO: 2, wherein SEQ ID NO: 2 is

MIKLAKFPRDFVWGTATSSYQIEGAVNEDGRTPSIWDTFSKTEGKTYK

GHTGDVACDHYHRYKEDVEILKEIGVKAYRFSIAWPRIFPEEGKYNPK

GMDFYKKLIDELQKRDIVPAATIYHWDLPQWAYDKGGGWLNRESIKWY

VEYATKLFEELGDAIPLWITHNEPWCSSILSYGIGEHAPGHKNYREAL

IAAHHILLSHGEAVKAFREMNIKGSKIGITLNLTPAYPASEKEEDKLA

AQYADGFANRWFLDPIFKGNYPEDMMELYSKIIGEFDFIKEGDLETIS

VPIDFLGVNYYTRSIVKYDEDSMLKAENVPGPGKRTEMGWEISPESLY

DLLKRLDREYTKLPMYITENGAAFKDEVTEDGRVHDDERIEYIKEHLK

AAAKFIGEGGNLKGYFVWSLMDNFEWAHGYSKRFGIVYVDYTTQKRIL

KDSALWYKEVILDDGIED*,

In some embodiments, the present invention provides novel enzymes that are variants of a wild type *Thermoanaerobacter brockii* cellobiase enzyme (e.g., CglT), which has β-glucosidase activity (SEQ ID NO: 2), and is a member of glycoside hydrolase family 1 (GH1). The glycoside hydrolase family classification is well known in the art and is described in, for example, Cantarel et al. (2008) The Carbohydrate-Active EnAymes database (CAZy): an expert resource for Glycogenomics, *Nucleic Acids Res.* 37:D233-238 and the world wide web at cazy.org, which are incorporated herein by reference; see also, Henrissat et al. (1991) "A classification of glycosyl hydrolases based on amino-acid sequence similarities" *Biochem. J.* 280:309-316, Henrissat et al. (1993) "New families in the classification of glycosyl hydrolases based on amino-acid sequence similarities" *Biochem. J.* 293:781-788, Henrissat et al. (1996) "Updating the sequence-based classification of glycosyl hydrolases" *Biochem. J.* 316:695-696, and Davies et al. (1995) "Structures and mechanisms of glycosyl hydrolases" *Structure* 3:853-859, which are incorporated herein by reference.

More specifically, the present invention provides an isolated, recombinant and/or variant β-glucosidase polypeptide comprising an amino acid sequence that is at least about 85% identical to wild type *Thermoanaerobacter brockii* β-glucosidase (SEQ ID NO: 2) and having at least one substitution of an amino acid residue at a position selected from the group of F11, N27, S34, Y47, K48, E64, I81, A82, P84, K103, R111, Y129, K131, G134, K142, K150, E153, A158, I159, H202, A205, K215, I221, T222, Y229, A231, L239, A241, D254, I256, F257, E285, T286, I291, I303, D307, W328, I330, S334, M351, Y352, L383, F389, K397, H412, T427, K429, V442, D445, D446, and/or *451Q/P, wherein amino acid position is determined by alignment with SEQ ID NO: 2. In some embodiments the alignment with SEQ ID NO: 2 is an optimal alignment. "*" refers herein to the absence of an amino acid residue at the designated position in the reference sequence. Amino acid position 451 is the position following the C-terminus of wild type *Thermoanaerobacter brockii* β-glucosidase (SEQ ID NO: 2).

In some embodiments, the present invention provides an isolated, recombinant and/or variant β-glucosidase polypeptide comprising an amino acid sequence that is at least about 85% identical to wild type *Thermoanaerobacter brockii* β-glucosidase (SEQ ID NO: 2) and having at least one substitution selected from the group of F11L, N27D, S34G, Y47H, K48N, E64V/K, I81V, A82P, P84T, K103E, R111H, Y129F, K131I, G134D, K142E, K150R, E153G, A158V, I159V, H202Y, A205V/G, K215E, I221V, T222A, Y229H, A231T, L239M, A241T, D254G, I256V, F257S, E285G, T286A, I291N, I303V, D307A, W328L, I330V, S334P, M351L, Y352H, L383H, F389I, K397N, H412W/L/F/V, T427S, K429N, V442A, D445E, D446E, and/or *451Q/P, wherein amino acid position is determined by alignment with SEQ ID NO: 2. In some embodiment, the alignment with SEQ ID NO: 2 is an optimal alignment.

In some embodiments, β-glucosidase polypeptides encompassed by the invention include those having an amino acid sequence that is at least about 86% identical to SEQ ID NO: 2 and having one or more of the above-identified substitutions. Certain of these β-glucosidase polypeptides may be at least about 87% identical, at least about 88% identical, at least about 89% identical, at least about 90% identical, at least about 91% identical, at least about 92% identical, at least about 93% identical, at least about 94% identical, at least about 95% identical, at least about 96% identical, at least about 97% identical, at least about 98% or at least about 99% identical to SEQ ID NO: 2.

In some embodiments, the isolated, recombinant or variant β-glucosidase polypeptide will comprise a substitution at an amino acid position corresponding to N27, E64, P84, Y129, K131, K215, L239, I303, D307, W328, I330, T427, and *451, or combinations thereof and/or in combination with at least 1, at least 2, at least 3, at least 4 and at least 5 other amino acid substitutions of SEQ ID NO: 2 or a sequence having at least 95%, at least 96%, at least 97%, at least 98% or at least 99% sequence identity to SEQ ID NO: 2. Exemplary substitutions include N27D, E64V, P84T, Y129F, K131I, K215E, L239M, I303V, D307A, W328L, I330V, T427S, and *451Q/P. In other embodiments, the isolated, recombinant or variant β-glucosidase polypeptide will comprise a substitution at an amino acid position corresponding to N27, E64, P84, Y129, K131, L239, I303, D307, W328, T427 or combinations thereof and/or in combination with at least 1, at least 2, at least 3, at least 4 and at least 5 other amino acid substitutions of SEQ ID NO: 2 or a sequence having at least 95%, at least 96%, at least 97%, at least 98% or at least 99% sequence identity to SEQ ID NO: 2. Exemplary substitutions include N27D, E64V, P84T, Y129F, K131I, L239M, I303V, D307A, W328L, and T427S. In some embodiments, the substitutions will include N27D, E64K, P84T, Y129F, L239M, I303V and/or D307A, wherein amino acid position is determined by alignment (e.g., optimal alignment) with SEQ ID NO: 2. In other embodiments, the substitutions will include N27D, Y129F, L239M, and/or D307A. In certain embodiments, the substitutions will include P84T, E64I, 330V, K215E, and *451Q.

Some further embodiments of the invention include variants having a substitution at a position selected from the group consisting of A16, T17. S18, Q21, W36, R78, H121, W122, N166, E167, W169, C170, L174, I178, E180, H181, T222, L223, N224, L225, T226, N297, Y298, Y299, T300, M326, W328, T354, E355, N356, W402, S403, N407, F408, E409, W410, A411, H412, K416, F418 or combination of two or more thereof, wherein amino acid position is determined by alignment (e.g., optimal alignment) with SEQ ID NO: 2.

Yet other embodiments include variants having a substitution at a position selected from the group consisting of P33, I35, D37, T38, F39, T42, E43, G44, K45, Q126, W127, D130, K131, G132, G133, L136, N137, R138, Y176, G177, G179, A182, P183, G184, H185, K186, N187, Y188, R189, E190, I193, G274, E275, I279, M311 or combination of two or more thereof, wherein amino acid position is determined by alignment (e.g., optimal alignment) with SEQ ID NO:2.

The present invention further provides an isolated, recombinant and/or variant β-glucosidase polypeptide comprising an amino acid sequence that is at least about 96% identical, that is at least about 97% identical, at least 98% identical to or at least 99% identical to SEQ ID NO: 4 wherein SEQ ID NO: 4 comprises

MIKLAKFPRDFVWGTATSSYQIEGAVNEDGRTPSIWDTFSKTEGKTYK

GHTGDVACDHYHRYKEDVEILKEIGVKAYRFSIAWPRIFPEEGKYNPK

GMDFYKKLIDELQKRDIVPAATIYHWDLPQWAYDIGGGWLNRESIKWY

VEYATKLFEELGDAIPLWITHNEPWCSSILSYGIGEHAPGHKNYREAL

IAAHHILLSHGEAVKAFREMNIKGSKIGITLNLTPAYPASEKEEDKLA

AQYADGFANRWFLDPIFKGNYPEDMMELYSKIIGEFDFIKEGDLETIS

VPIDFLGVNYYTRSVVKYAEDSMLKAENVPGPGKRTEMGWEVSPESLY

RDLLKRLDREYTKLPMYITENGAAFKDEVTEDGVHDDERIEYIKEHLK

AAAKFIGEGGNLKGYFVWSLMDNFEWAHGYSKRFGIVYVDYTTQKRIL

KDSALWYKEVILDDGIED.

In some embodiments, these isolated, recombinant and/or variant β-glucosidase polypeptides have one or more substitutions at a position selected from the group consisting of F11, N27, S34, Y47, K48, E64, I81, A82, P84, K103, R111, Y129, G134, K142, K150, E153, A158, I159, H202, A205, K215, I221, T222, Y229, A231, L239, A241, D254, I256, F257, E285, T286, I291, W328, S334, M351, Y352, L383, F389, K397, H412, T427, K429, V442, D445, D446, and/or *451Q/P, wherein amino acid position is determined by alignment with SEQ ID NO: 4. Exemplary substitutions include substitution selected from the group consisting of F11L, N27D, S34G, Y47H, K48N, E64V, E64K, I81V, A82P, P84T, K103E, R111H, Y129F, G134D, K142E, K150R, E153G, A158V, I159V, H202Y, A205V/G, K215E, I221V, T222A, Y229H, A231T, L239M, A241T, D254G, I256V, F257S, E285G, T286A, I291N, W328L, S334P, M351L, Y352H, L383H, F389I, K397N, H412W/L/F/V, T427S, K429N, V442A, D445E, D446E, and *451Q/P, wherein amino acid position is determined by alignment with SEQ ID NO: 4.

In accordance with the present invention, β-glucosidase activity can be determined by methods known in the art. Preferred assays to determine activity include the assay of Example 3 (e.g., for wild-type β-glucosidase activity) and Example 4 (e.g., for variant β-glucosidase activity.

β-glucosidase polypeptides of the present invention include those encoded by a nucleic acid that hybridizes under stringent conditions over the entire length of a nucleic acid corresponding to a reference nucleic acid sequence selected from the group consisting of SEQ ID NO: 1, and the complementary sequence thereof, wherein the encoded polypeptide has an amino acid sequence comprising one or more substitutions selected from the group of F11, N27, S34, Y47, K48, E64, I81, A82, P84, K103, R111, Y129, K131, G134, K142, K150, E153, A158, I159, H202, A205, K215, I221, T222, Y229, A231, L239, A241, D254, I256, F257, E285, T286, I291, I303, D307, W328, I330, S334, M351, Y352, L383, F389, K397, H412, T427, K429, V442, D445, D446, and/or *451Q/P, wherein amino acid position is determined by optimal alignment with SEQ ID NO: 2.

In some embodiments of the present invention, β-glucosidase polypeptides of the present invention include those encoded by a nucleic acid that hybridizes under stringent conditions over the entire length of a nucleic acid corresponding to a reference nucleic acid sequence selected from the group consisting of SEQ ID NO: 1 and the complementary sequence thereof, wherein the encoded polypeptide has an amino acid sequence comprising one or more substitutions selected from the group of F11L, N27D, S34G, Y47H, K48N, E64V/K, I81V, A82P, P84T, K103E, R111H, Y129F, K131I, G134D, K142E, K150R, E153G, A158V, I159V, H202Y, A205V/G, K215E, I221V, T222A, Y229H, A231T, L239M, A241T, D254G, I256V, F257S, E285G, T286A, I291N, I303V, D307A, W328L, I330V, S334P, M351L, Y352H, L383H, F389I, K397N, H412W/L/F/V, T427S, K429N, V442A, D445E, D446E, and/or *451Q/P, wherein amino acid position is determined by optimal alignment with SEQ ID NO: 2.

In some embodiments, β-glucosidase polypeptides of the present invention include those having improved (e.g., greater) β-glucosidase activity relative to wild-type T. brockii β-glucosidase (SEQ ID NO: 2). Improved β-glucosidase activity may be measured by assays described in Examples 3 and 4. For example, β-glucosidase polypeptides of the present invention often have β-glucosidase activity that is at least about 1-fold, at least about 2-fold, at least about 3-fold, at least about 4-fold, at least about 5-fold, at least about 6-fold-, at least about 7-fold, at least about 8-fold, at least about 9-fold, and up to about 10-fold or greater β-glucosidase activity as compared to wild type T. brockii (SEQ ID NO: 2), as measured for example in the assay described in Example 4.

Certain of the β-glucosidase polypeptides of the present invention further exhibit greater resistance to inhibition by glucose than wild type Thermoanaerobacter brockii β-glucosidase (SEQ ID NO: 2), as measured in the assay of Example 4. These β-glucosidase polypeptides typically exhibit at least about 1.5-fold greater β-glucosidase activity than that of wild type T. brockii (SEQ ID NO: 2) for example in the presence of 50 g/l glucose, as measured in the assay described in Example 4 (using the protocol with added glucose). Some invention β-glucosidase polypeptides exhibit at least about 2-fold, sometimes at least about 2.5-fold or at least about 3-fold or greater β-glucosidase activity than that of wild type T. brockii (SEQ ID NO: 2) both in the presence of 50 g/l glucose, as measured in the assay described in Example 4 (using the protocol with added glucose). Some β-glucosidase polypeptides of the present invention exhibit greater β-glucosidase activity as compared to wild type T. brockii (SEQ ID NO: 2) in the presence of even more glucose, e.g., 100 g/l glucose, as measured in the assay of Example 4 (using the protocol with added glucose). These invention polypeptides typically exhibit at least about 1.5-fold, sometimes at least about 2-fold or at least about 2.5-fold, in some cases at least about 3-fold, and up to about 4-fold or greater β-glucosidase activity as compared to wild type T. brockii (SEQ ID NO: 2), in the presence of 100 g/l glucose, as measured in the assay of Example 4 (using the protocol with added glucose).

In some instances, a variant of the invention will produce at least 0.5 times, at least 1.0 times, at least 1.5 times, at least 2.0 times, at least 3.0 times, at least 4.0 times, at least 5.0 times, at least 10 times more glucose as compared to the amount of glucose produce from the hydrolysis of cellobiose substrate by the cellobiase of SEQ ID NO: 2 under substantially the same conditions.

The present invention further provides an isolated or recombinant β-glucosidase polypeptide variant having an amino acid sequence that has a substitution, deletion, and/or insertion of from one to twenty amino acid residues in a sequence selected from the group consisting of SEQ ID NO: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, and 124, wherein the polypeptide exhibits at least about 2-fold greater β-glucosidase activity than wild type *Thermoanaerobacter brockii* β-glucosidase (SEQ ID NO: 2), as measured in the assay of, for example, Example 4 (using the protocol without added glucose). These β-glucosidase polypeptides may have a substitution, deletion, and/or insertion of from one to two, or from one or two, to three, four, five, six, seven, eight, nine, ten, eleven, twelve, thirteen, fourteen, fifteen, sixteen, seventeen, eighteen, nineteen and up to twenty residues. Typically, these β-glucosidases exhibit β-glucosidase activity that is: (a) at least about 3-fold, at least about 4-fold, at least about 5-fold, at least about 6-fold-, at least about 7-fold, at least about 8-fold, at least about 9-fold, and often between about 3-fold and about 10-fold greater β-glucosidase activity as compared to wild type *T. brockii* (SEQ ID NO: 2), as measured in the assay described in Example 4 (using the protocol without added glucose); (b) at least about 2.5-fold or at least about 3-fold greater β-glucosidase activity than that of wild type *T. brockii* (SEQ ID NO: 2) both in the presence of 50 g/l glucose, as measured in the assay described in Example 4 (using the protocol with added glucose); and/or (c) at least about 2.5-fold, in some cases at least about 3-fold or 3.5-fold, and up to about 4-fold greater β-glucosidase activity as compared to wild type *T. brockii* (SEQ ID NO: 2), both in the presence of 100 g/l glucose, as measured in the assay of Example 4 (using the protocol with added glucose).

The amino acid sequences of the β-glucosidase polypeptides described herein may have any combination of substitutions at the above-described amino acid positions such as 2 or more, 3 or more, 4 or more, 5 or more, 6 or more, 7 or more, 8 or more, 9 or more, 10 or more, 11 or more, 12 or more, 13 or more, 14 or more, 15 or more, 16 or more, 17 or more, 18 or more, 19 or more, 20 or more, 21 or more, 22 or more, 23 or more, 24 or more, 25 or more, 26 or more, 27 or more, 28 or more, 29 or more, 30 or more, 31 or more, 32 or more, 33 or more, 34 or more, 35 or more, 36 or more, 37 or more, 38 or more, 39 or more, 40 or more, 41 or more, 42 or more, 43 or more, 44 or more, 45 or more, 46 or more, 47 or more, 48 or more, 49 or more, 50 or more, or at all 51 of the following positions including the substitutions: F11L, N27D, S34G, Y47H, K48N, E64V, E64K, I81V, A82P, P84T, K103E, R111H, Y129F, K131I, G134D, K142E, K150R, E153G, A158V, I159V, H202Y, A205V/G, K215E, I221V, T222A, Y229H, A231T, L239M, A241T, D254G, I256V, F257S, E285G, T286A, I291N, I303V, D307A, W328L, I330V, S334P, M351L, Y352H, L383H, F389I, K397N, H412W/L/F/V, T427S, K429N, V442A, D445E, D446E, and *451Q/P, wherein amino acid position is determined by alignment with SEQ ID NO: 2.

The present invention includes conservatively modified variants of the β-glucosidase polypeptides described herein. These variants have conservative substitutions made in their amino acid sequences. Examples of conservative substitutions are within the group of basic amino acids (arginine, lysine and histidine), acidic amino acids (glutamic acid and aspartic acid), polar amino acids (glutamine and asparagines), hydrophobic amino acids (leucine, isoleucine and valine), aromatic amino acids (phenylalanine, tryptophan and tyrosine), and small amino acids (glycine, alanine, serine, threonine, proline, cysteine and methionine). Amino acid substitutions which do not generally alter the specific activity are known in the art and are described, for example, by H. Neurath and R. L. Hill, 1979, in "The Proteins," Academic Press, New York. The most commonly occurring exchanges are Ala/Ser, Val/Ile, Asp/Glu, Thr/Ser, Ala/Gly, Ala/Thr, Ser/Asn, Ala/Val, Ser/Gly, Tyr/Phe, Ala/Pro, Lys/Arg, Asp/Asn, Leu/Ile, Leu/Val, Ala/Glu, and Asp/Gly as well as these in reverse.

Conservatively substituted variations of the β-glucosidase polypeptides of the present invention include substitutions of a small percentage, typically less than 5%, more typically less than 2%, and often less than 1% of the amino acids of the polypeptide sequence, with a conservatively selected amino acid of the same conservative substitution group. The addition of sequences which do not alter the encoded activity of a β-glucosidase polynucleotide, such as the addition of a non-functional or non-coding sequence, is considered a conservative variation of the β-glucosidase polynucleotide.

Sequence-activity analyses indicated that certain of the above-described mutations/substitutions appeared particularly favorable with respect to increasing β-glucosidase activity relative to wild type *Thermoanaerobacter brockii* β-glucosidase (SEQ ID NO: 2). Sequence-activity analysis was performed in accordance with the methods described in WO 03/075129, U.S. Ser. No. 10/379,378 filed Mar. 3, 2003, and R. Fox et al., "Optimizing the search algorithm for protein engineering by directed evolution," *Protein Eng.* 16(8):589-597 (2003), all of which are incorporated herein by reference. See also R. Fox et al., "Directed molecular evolution by machine learning and the influence of nonlinear interactions," *J. Theor. Biol.* 234(2):187-199 (2005), which is incorporated herein by reference.

A structural homology model of the parent *T. brockii* β-glucosidase (SEQ ID NO: 2), was constructed using the crystal structure of the *Thermotoga maritima* β-glucosidase in complex with 2-castanospermine (2CBU). See Gloster, et al. (2006) *Chembiochem* vol. 7, p. 738, which is incorporated herein by reference. Although the *T. brockii* β-glucosidase (SEQ ID NO: 2) has only approximately 53% sequence identity with respect to the *Thermotoga maritima* β-glucosidase, both enzymes are classified in the same glycoside hydrolase family 1 (GH1), and therefore, their structures are believed to be similar. A dimer form of the structure was generated using symmetry and the resulting structure used as a template to build a model. The *T. brockii* β-glucosidase is a dimer of two monomers each having a binding and catalytic site. Cellobiose was modeled into the active site by superimposing one of the glucose sugar rings of cellobiose with the sugar group in 2-castanospermine. The location of each beneficial mutation was then determined on the modeled structure. This structural analysis indicated that the beneficial mutations were located in four domains of the protein. These domains are the substrate binding pocket, the dimer interface, the surface, and the core.

As used herein, the term "binding pocket" refers to any amino acid residue with an atom within 7 Angstroms of any atom in the modeled cellobiose. These positions are: A16, T17, S18, Q21, W36, R78, H121, W122, N166, E167, W169, C170, L174, I178, E180, H181, T222, L223, N224, L225, T226, N297, Y298, Y299, T300, M326, W328, T354, E355, N356, W402, S403, N407, F408, E409, W410, A411, H412, K416, and F418.

The term "interface" refers herein to any residue that has an atom within 7 Angstroms of any atom which is part of the other monomer in the dimer. These positions are: P33, I35, D37, T38, F39, T42, E43, G44, K45, Q126, W127, D130, K131, G132, G133, L136, N137, R138, Y176, G177, G179, A182, P183, G184, H185, K186, N187, Y188, R189, E190, I193, G274, E275, and M311.

As used herein, the term "surface residue" refers to any residue exposing at least 30% of its relative accessible surface area and not included in the binding pocket or interface. Relative accessible surface area is the percent of exposed surface relative to the same residue sandwiched between two alanine residues. Probe size for solvent accessible surface area is 1.4 Angstroms. These positions are: L4, A5, K6, P8, R9, D10, N27, E28, D29, G30, Y47, K48, G49, D53, V54, H60, R61, K63, E64, E67, K70, E71, G73, K75, E89, G91, K92, Y93, P95, K96, D99, K102, K103, D106, Q109, K110, D112, E139, K142, E146, E153, D157, P160, K207, R210, E211, M212, I214, K215, G216, K218, Y229, A231, S232, E233, K234, E235, E236, K238, L239, Q242, F257, K258, G259, N260, E263, M266, E267, S270, K271, I272, I273, D277, F278, E281, G282, E285, T286, S288, P290, K305, Y306, D307, E308, D309, S310, L312, K313, A314, E315, N316, V317, P318, G321, K322, R323, T324, E325, G327, I330, E333, D337, R341, R344, E345, T347, L349, A359, K361, E363, V364, T365, E366, D367, G368, R369, H371, D373, E374, E377, K380, E381, K384, K388, G391, E392, G393, N395, K397, S415, T426, T427, K429, L432, L437, E441, L444, D445, D446, and *451.

All other positions are relatively buried in the protein structure. These buried positions are referred to herein as "core domain positions". The core domain positions are: F7, F11, V12, W13, G14, T15, S19, Y20, I22, E23, G24, A25, V26, R31, T32, S34, S40, K41, T46, H50, T51, G52, A55, C56, D57, H58, Y59, Y62, D65, V66, I68, L69, I72, V74, A76, Y77, F79, S80, I81, A82, W83, P84, R85, I86, F87, P88, E90, N94, G97, M98, F100, Y101, L104, I105, E107, L108, R111, I113, V114, P115, A116, A117, T118, I119, Y120, D123, L124, P125, A128, Y129, G134, W135, S140, I141, W143, Y144, V145, Y147, A148, T149, K150, L151, F152, E154, L155, G156, A158, I159, L161, W162, I163, T164, H165, P168, S171, S172, I173, S175, A191, L192, A194, A195, H196, H197, I198, L199, L200, S201, H202, G203, E204, A205, V206, A208, F209, N213, S217, I219, G220, I221, P227, A228, P230, D237, A240, A241, Y243, A244, D245, G246, F247, A248, N249, R250, W251, F252, L253, D254, P255, I256, Y261, P262, D264, M265, L268, Y269, F276, K280, D283, L284, I287, Y289, I291, D292, F293, L294, G295, V296, R301, S302, I303, V304, G319, P320, E329, S331, P332, S334, L335, Y336, L338, L339, K340, L342, D343, Y346, K348, P350, M351, Y352, I353, G357, A358, F360, D362, V370, D372, R375, I376, Y378, I379, H382, L383, A385, A386, A387, F389, I390, G394, L396, G398, Y399, F400, V401, L404, M405, D406, G413, Y414, R417, G419, I420, V421, Y422, V423, D424, Y425, Q428, R430, I431, K433, D434, S435, A436, W438, Y439, K440, V442, I443, G447, I448, E449, and D450.

It is believed that modifications in the binding pocket tend to affect binding, product inhibition, and catalytic rate and that modifications in residues in the surface, interface, and core domains tend to affect expression and thermostability, and other properties by indirect modification of the active site.

The present invention further provides an isolated or recombinant β-glucosidase polypeptide variant derived from a parent β-glucosidase classified in glycoside hydrolase family 1 (GH1), said GH1 β-glucosidase polypeptide variant comprising a substrate binding domain, a surface domain, and a core domain, wherein the β-glucosidase variant polypeptide comprises an amino acid sequence having a substitution, relative to the amino acid sequence of the parent GH1 β-glucosidase, in a position selected from the group consisting of: (a) a surface domain residue position selected from the group consisting of position 4, 5, 6, 8, 9, 10, 27, 28, 29, 30, 47, 48, 49, 53, 54, 60, 61, 63, 64, 67, 70, 71, 73, 75, 89, 91, 92, 93, 95, 96, 99, 102, 103, 106, 109, 110, 112, 139, 142, 146, 153, 157, 160, 207, 210, 211, 212, 214, 215, 216, 218, 229, 231, 232, 233, 234, 235, 236, 238, 239, 242, 257, 258, 259, 260, 263, 266, 267, 270, 271, 272, 273, 277, 278, 281, 282, 285, 286, 288, 290, 305, 306, 307, 308, 309, 310, 312, 313, 314, 315, 316, 317, 318, 321, 322, 323, 324, 325, 327, 330, 333, 337, 341, 344, 345, 347, 349, 359, 361, 363, 364, 365, 366, 367, 368, 369, 371, 373, 374, 377, 380, 381, 384, 388, 391, 392, 393, 395, 397, 415, 426, 427, 429, 432, 437, 441, 444, 445, 446, and 451; and (b) a core domain residue position selected from the group consisting of position 7, 11, 12, 13, 14, 15, 19, 20, 22, 23, 24, 25, 26, 31, 32, 34, 40, 41, 46, 50, 51, 52, 55, 56, 57, 58, 59, 62, 65, 66, 68, 69, 72, 74, 76, 77, 79, 80, 81, 82, 83, 84, 85, 86, 87, 88, 90, 94, 97, 98, 100, 101, 104, 105, 107, 108, 111, 113, 114, 115, 116, 117, 118, 119, 120, 123, 124, 125, 128, 129, 134, 135, 140, 141, 143, 144, 145, 147, 148, 149, 150, 151, 152, 154, 155, 156, 158, 159, 161, 162, 163, 164, 165, 168, 171, 172, 173, 175, 191, 192, 194, 195, 196, 197, 198, 199, 200, 201, 202, 203, 204, 205, 206, 208, 209, 213, 217, 219, 220, 221, 227, 228, 230, 237, 240, 241, 243, 244, 245, 246, 247, 248, 249, 250, 251, 252, 253, 254, 255, 256, 261, 262, 264, 265, 268, 269, 276, 280, 283, 284, 287, 289, 291, 292, 293, 294, 295, 296, 301, 302, 303, 304, 319, 320, 329, 331, 332, 334, 335, 336, 338, 339, 340, 342, 343, 346, 348, 350, 351, 352, 353, 357, 358, 360, 362, 370, 372, 375, 376, 378, 379, 382, 383, 385, 386, 387, 389, 390, 394, 396, 398, 399, 400, 401, 404, 405, 406, 413, 414, 417, 419, 420, 421, 422, 423, 424, 425, 428, 430, 431, 433, 434, 435, 436, 438, 439, 440, 442, 443, 447, 448, 449, and 450, wherein amino acid position is determined by optimal alignment of the GH1 β-glucosidase polypeptide variant and parent to SEQ ID NO: 2 and the substitution is with reference to the parent GH1 β-glucosidase polypeptide sequence. In some embodiments of the present invention, there is a substitution in both a surface domain residue and a core domain residue. As used herein, the terms "glycoside hydrolase family 1" or "GH1" refer to the well known classification of glycoside hydrolases described in Cantarel et al. (2008) The Carbohydrate-Active EnAymes database (CAZy): an expert resource for Glycogenomics, *Nucleic Acids Res.* 37:D233-238 and the world wide web at cazy.org, which are incorporated herein by reference. See also, Henrissat et al. (1991) "A classification of glycosyl hydrolases based on amino-acid sequence similarities" *Biochem. J.* 280:309-316, Henrissat et al. (1993) "New families in the classification of glycosyl hydrolases based on amino-acid sequence similarities" *Biochem. J.* 293:781-788, Henrissat et al. (1996) "Updating the sequence-based classification of glycosyl hydrolases" *Biochem. J.* 316:695-696, and Davies et al. (1995) "Structures and mechanisms of glycosyl hydrolases" *Structure* 3:853-859, which are incorporated herein by reference.

In some embodiments, the substitution is in a surface domain residue position that is selected from the group consisting of position 27, 47, 48, 64, 103, 142, 153, 215, 229, 231, 239, 257, 285, 286, 307, 330, 397, 427, 429, 445, 446, and 451 (where amino acid position is determined by optimal alignment of the GH1 β-glucosidase polypeptide variant and parent to SEQ ID NO: 2 and the substitution is with reference to the parent GH1 β-glucosidase polypeptide sequence). Exemplary substitutions include X27D, X47H, X48N, X64K, X103E, X142E, X153G, X215E, X229H, X231T, X239M, X257S, X285G, X286A, X307A, X330V, X397N, X427S, X429N, X445E, X446E, and X451Q/P. The designation X refers to the amino acid residue in the reference sequence, i.e., the parent GH1 β-glucosidase. In some embodiments, the substitution is in a core domain residue position that is selected from the group consisting of position 11, 34, 81, 82, 84, 111, 129, 134, 150, 158, 159, 202, 205, 215, 221, 241, 254, 256, 291, 303, 334, 351, 352, 383, 389, and 442 451 (where amino acid position is determined by optimal alignment of the GH1 β-glucosidase polypeptide variant and parent to SEQ ID NO: 2 and the substitution is with reference to the parent GH1 β-glucosidase polypeptide sequence). Exemplary substitutions include X11L, X34G, X81V, X82P, X84T, X111H, X129F, X134D, X150R, X158V, X159V, X202Y, X205V/G, X215E, X221V, X241T, X254G, X291N, X303V, X334P, X351L, X352H, X383H, X389I, and X442A.

In some embodiments, the isolated or recombinant β-glucosidase variant comprises a substitution (relative to the parent GH1 family β-glucosidase) in both a surface residue and a core domain residue. The present invention further provides an isolated or recombinant GH1 β-glucosidase polypeptide variant derived from a parent GH1 β-glucosidase variant comprising a substrate binding domain, a surface domain, and a core domain, wherein the β-glucosidase variant polypeptide comprises an amino acid sequence having a substitution, relative to the amino acid sequence of the parent β-glucosidase, in a position in the substrate binding domain selected from the group consisting of position 16, 17, 18, 21, 36, 78, 121, 122, 166, 167, 169, 170, 174, 1178, 180, 181, 222, 223, 224, 225, 226, 297, 298, 299, 300, 326, 328, 354, 355, 356, 402, 403, 407, 408, 409, 410, 411, 412, 416, and 418, wherein amino acid position is determined by optimal alignment of the GH1 β-glucosidase polypeptide variant and parent to SEQ ID NO: 2 and the substitution is with reference to the parent GH1 β-glucosidase polypeptide sequence. Typically, the substitution is in a substrate binding domain position selected from the group consisting of position 222, 328, and 412 (where amino acid position is determined by optimal alignment of the GH1 β-glucosidase polypeptide variant and parent to SEQ ID NO: 2 and the substitution is with reference to the parent GH1 β-glucosidase polypeptide sequence). Exemplary substitutions include X222A, X328L, and X412W/L/F/V.

The present invention also provides an isolated or recombinant GH1 β-glucosidase polypeptide variant derived from a parent β-glucosidase variant comprising a substrate binding domain, a surface domain, an interface domain, and a core domain, wherein the β-glucosidase variant polypeptide comprises an amino acid sequence having a substitution, relative to the amino acid sequence of the parent β-glucosidase, in a position in the interface domain selected from the group consisting of position 33, 35, 37, 38, 39, 42, 43, 44, 45, 126, 127, 130, 131, 132, 133, 136, 137, 138, 176, 177, 179, 182, 183, 184, 185, 186, 187, 188, 189, 190, 193, 274, 275, 279, and 311, wherein amino acid position is determined by optimal alignment of the GH1 β-glucosidase polypeptide variant and parent to SEQ ID NO: 2 and the substitution is with reference to the parent GH1 β-glucosidase polypeptide sequence. Typically, the substitution is in interface domain position 131 (where amino acid position is determined by optimal alignment of the GH1 β-glucosidase polypeptide variant and parent to SEQ ID NO: 2 and the substitution is with reference to the parent GH1 β-glucosidase polypeptide sequence). An exemplary substitution is X131I. Optionally, GH1 β-glucosidase polypeptide variants of the present invention having substitutions in the substrate binding domain and/or interface domain may have also have substitutions in the surface and/or core domains, as described hereinabove.

In another embodiment, the present invention also provides a fragment of the β-glucosidase polypeptides described herein having β-glucosidase activity such as those detected for example in the assay of Example 4 (using the protocol without added glucose). These fragments are referred to herein as "β-glucosidase fragments". As used herein, the term "fragment" refers to a polypeptide having a deletion of from 1 to about 25 amino acid residues from the carboxy terminus, the amino terminus, or both. In certain embodiments, the deletion will be from 1 to about 15 amino acid residues from the amino terminus and from 1 to about 30 amino acid residues from the carboxy terminus. In some embodiments, the deletion may be from 1 to about 10 residues, or 1 to about 5 residues from the carboxy terminus, the amino terminus, or both. β-glucosidase fragments of the present invention include those that have: (a) at least about 3-fold, at least about 4-fold, at least about 5-fold, at least about 6-fold-, at least about 7-fold, at least about 8-fold, at least about 9-fold, and up to about 10-fold or greater β-glucosidase activity as compared to wild type *T. brockii* (SEQ ID NO: 2), as measured in the assay described in Example 4 (using the protocol without added glucose); (b) at least about 2.5-fold or at least about 3-fold greater β-glucosidase activity than that of wild type *T. brockii* (SEQ ID NO: 2) both in the presence of 50 g/l glucose, as measured in the assay described in Examples 3 and/or 4 (using the protocol with added glucose); and/or (c) at least about 2.5-fold, in some cases at least about 3-fold or 3.5-fold, and up to about 4-fold greater β-glucosidase activity as compared to wild type *T. brockii* (SEQ ID NO: 2), both in the presence of 100 g/l glucose, as measured in the assay of Examples 3 and/or 4 (using the protocol with added glucose).

The amino acid and polynucleotide sequences of β-glucosidase polypeptides not specifically described herein can be readily generated and identified using methods that are well known to those having ordinary skill in the art. Libraries of these β-glucosidase polypeptide variants may be generated and screened using the high throughput screen for presence of β-glucosidase activity described in Examples 3 and/or 4. In some instances it may be desirable to identify β-glucosidase polypeptide variants that exhibit β-glucosidase activity in the presence of glucose and reference is made to Example 4.

Methods for generating variant libraries are well known in the art. For example, mutagenesis and directed evolution methods can be readily applied to polynucleotides (such as, for example, wild-type *T. brockii* β-glucosidase encoding polynucleotides (e.g., SEQ ID NO: 1) or the polynucleotides of the present invention (described hereinbelow) to generate variant libraries that can be expressed, screened, and assayed using the methods described herein. Mutagenesis and directed evolution methods are well known in the art. See, e.g., Ling, et al., "Approaches to DNA mutagenesis: an overview," *Anal. Biochem.*, 254(2):157-78 (1997); Dale, et al., "Oligonucleotide-directed random mutagenesis using the phosphorothioate method," *Methods Mol. Biol.*, 57:369-74 (1996); Smith, "In vitro mutagenesis," *Ann. Rev. Genet.*, 19:423-462 (1985); Botstein, et al., "Strategies and applications of in vitro mutagenesis," *Science*, 229:1193-1201 (1985); Carter, "Site-directed mutagenesis," *Biochem. J.*, 237:1-7 (1986); Kramer, et al., "Point Mismatch Repair," *Cell*, 38:879-887 (1984); Wells, et al., "Cassette mutagenesis: an efficient method for generation of multiple mutations at defined sites," *Gene*, 34:315-323 (1985); Minshull, et al., "Protein evolution by molecular breeding," *Current Opinion in Chemical Biology*, 3:284-290 (1999); Christians, et al., "Directed evolution of thymidine kinase for AZT phosphorylation using DNA family shuffling," *Nature Biotechnology*, 17:259-264 (1999); Crameri, et al., "DNA shuffling of a family of genes from diverse species accelerates directed evolution," *Nature,* 391:288-291; Crameri, et al., "Molecular evolution of an arsenate detoxification pathway by DNA shuffling," *Nature Biotechnology,* 15:436-438 (1997); Zhang, et al., "Directed evolution of an effective fucosidase from a galactosidase by DNA shuffling and screening," *Proceedings of the National Academy of Sciences, U.S.A.,* 94:45-4-4509; Crameri, et al., "Improved green fluorescent protein by molecular evolution using DNA shuffling," *Nature Biotechnology,* 14:315-319 (1996); Stemmer, "Rapid evolution of a protein in vitro by DNA shuffling," *Nature,* 370:389-391 (1994); Stemmer, "DNA shuffling by random fragmentation and reassembly: In vitro recombination for molecular evolution," *Proceedings of the National Academy of Sciences, U.S.A.,* 91:10747-10751 (1994); WO 95/22625; WO 97/0078; WO 97/35966; WO 98/27230; WO 00/42651; and WO 01/75767, all of which are incorporated herein by reference.

Exemplary β-glucosidase polypeptides of the invention include those corresponding to SEQ ID NOs: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122 and/or 124.

In some embodiments, a β-glucosidase polypeptide variant of the present invention includes one or more additional sequences. For example, the β-glucosidase may be linked to an epitope tag or to another sequence useful in facilitating the purification of the β-glucosidase.

The present invention also provides β-glucosidase variant fusion polypeptides, wherein the fusion polypeptide comprises an amino acid sequence encoding a β-glucosidase variant polypeptide of the present invention or fragment thereof, linked either directly or indirectly through the N- or C-terminus of the β-glucosidase variant polypeptide to an amino acid sequence encoding at least a second (additional) polypeptide. The β-glucosidase variant fusion polypeptide may further include amino acid sequence encoding a third, fourth, fifth, or additional polypeptides. Typically, each additional polypeptide has a biological activity, or alternatively, is a portion of a polypeptide that has a biological activity, where the portion has the effect of improving expression and/or secretion of the fusion polypeptide from the desired expression host. These sequences may be fused, either directly or indirectly, to the N- or C-terminus of the additional polypeptides having biological activity.

Typically, the additional polypeptide(s) encode an enzyme or active fragment there, and/or a polypeptide that improves expression and/or secretion of the fusion polypeptide from the desired expression host cell. More typically, the additional polypeptide(s) encode(s) a cellulase (for example, a β-glucosidase having a different amino acid sequence from the β-glucosidase variant polypeptide in the fusion polypeptide (e.g., a wild type β-glucosidase or a variant thereof, including a different *T. brockii* β-glucosidase variant polypeptide), or a polypeptide exhibiting CBH or EG activity) and/or a polypeptide that improves expression and secretion from the desired host cell, such as, for example, a polypeptide that is normally expressed and secreted from the desired expression host, such as a secreted polypeptide normally expressed from a filamentous fungi. These include, for example, glucoamylase, α-amylase and aspartyl proteases from *Aspergillus niger, Aspergillus niger* var. *awamori,* and *apservillus oryzae,* cellobiohydrolase I, cellobiohydrolase II, endoglucanase I and endoglucanase III from *Trichoderma* and glucoamylase from *Neurospora* and *Humicola* species. See WO 98/31821, which is incorporated herein by reference.

The polypeptide components of the fusion polypeptide may be linked to each other indirectly via a linker. Linkers suitable for use in the practice of the present invention as well known in the art and are described, for example, in WO 2007/075899, which is incorporated herein by reference. Exemplary linkers include peptide linkers of from 1 to about 40 amino acid residues in length, including those from about 1 to about 20 amino acid residues in length, and those from about 1 to about 10 amino acid residues in length. In some embodiments, the linkers may be made up of a single amino acid residue, such as, for example, a Gly, Ser, Ala, or Thr residue or combinations thereof, particularly Gly and Ser. Linkers employed in the practice of the present invention may be cleavable. Suitable cleavable linkers may contain a cleavage site, such as a protease recognition site. Exemplary protease recognition sites are well known in the art and include, for example, Lys-Arg (the KEX2 protease recognition site, which can be cleaved by a native *Aspergillus* KEX2-like protease), and Lys and Arg (the trypsin protease recognition sites). See, for example WO 2007/075899 and WO 98/31821, which are incorporated herein by reference.

β-Glucosidase Polynucleotides

The present invention provides isolated or recombinant polynucleotides that encode any of the above-described β-glucosidase polypeptides.

Those having ordinary skill in the art will readily appreciate that due to the degeneracy of the genetic code, a multitude of nucleotide sequences encoding β-glucosidase polypeptides of the present invention exist. Table I is a Codon Table that provides the synonymous codons for each amino acid. For example, the codons AGA, AGG, CGA, CGC, CGG, and CGU all encode the amino acid arginine. Thus, at every position in the nucleic acids of the invention where an arginine is specified by a codon, the codon can be altered to any of the corresponding codons described above without altering the encoded polypeptide. It is understood that U in an RNA sequence corresponds to T in a DNA sequence.

TABLE 1

Codon Table

| Amino acids | | Codon | |
|---|---|---|---|
| Alanine | Ala | A | GCA GCC GCG GCU |
| Cysteine | Cys | C | UGC UGU |
| Aspartic acid | Asp | D | GAC GAU |
| Glutamic acid | Glu | E | GAA GAG |
| Phenylalanine | Phe | F | UUC UUU |
| Glycine | Gly | G | GGA GGC GGG GGU |
| Histidine | His | H | CAC CAU |
| Isoleucine | Ile | I | AUA AUC AUU |
| Lysine | Lys | K | AAA AAG |
| Leucine | Leu | L | UUA UUG CUA CUC CUG CUU |
| Methionine | Met | M | AUG |
| Asparagine | Asn | N | AAC AAU |
| Proline | Pro | P | CCA CCC CCG CCU |
| Glutamine | Gln | Q | CAA CAG |

TABLE 1-continued

Codon Table

| Amino acids | | | Codon |
|---|---|---|---|
| Arginine | Arg | R | AGA AGG CGA CGC CGG CGU |
| Serine | Ser | S | AGC AGU UCA UCC UCG UCU |
| Threonine | Thr | T | ACA ACC ACG ACU |
| Valine | Val | V | GUA GUC GUG GUU |
| Tryptophan | Trp | W | UGG |
| Tyrosine | Tyr | Y | UAC UAU |

Such "silent variations" are one species of "conservative" variation. One of ordinary skill in the art will recognize that each codon in a nucleic acid (except AUG, which is ordinarily the only codon for methionine) can be modified by standard techniques to encode a functionally identical polypeptide. Accordingly, each silent variation of a nucleic acid which encodes a polypeptide is implicit in any described sequence. The invention contemplates and provides each and every possible variation of nucleic acid sequence encoding a polypeptide of the invention that could be made by selecting combinations based on possible codon choices. These combinations are made in accordance with the standard triplet genetic code (set forth in Table 1), as applied to the polynucleotide sequences of the present invention.

A group of two or more different codons that, when translated in the same context, all encode the same amino acid, are referred to herein as "synonymous codons." β-glucosidase polynucleotides of the present invention may be codon optimized for expression in a particular host organism by modifying the polynucleotides to conform with the optimum codon usage of the desired host organism. Those having ordinary skill in the art will recognize that tables and other references providing preference information for a wide range of organisms are readily available See e.g., Henaut and Danchin in "*Escherichia coli* and *Salmonella*," Neidhardt, et al. Eds., ASM Pres, Washington D.C. (1996), pp. 2047-2066, which is incorporated herein by reference.

The terms "conservatively modified variations" and "conservative variations" are used interchangeably herein to refer to those nucleic acids that encode identical or essentially identical amino acid sequences, or in the situation where the nucleic acids are not coding sequences, the term refers to nucleic acids that are identical. One of ordinary skill in the art will recognize that individual substitutions, deletions or additions which alter, add or delete a single amino acid or a small percentage of amino acids in an encoded sequence are considered conservatively modified variations where the alterations result in one or more of the following: the deletion of an amino acid, addition of an amino acid, or substitution of an amino acid with a chemically similar amino acid. When more than one amino acid is affected, the percentage is typically less than 5% of amino acid residues over the length of the encoded sequence, and more typically less than 2%. References providing amino acids that are considered conservative substitutions for one another are well known in the art.

An exemplary β-glucosidase polynucleotide sequence of the present invention is provided as SEQ ID NO: 1, which is a polynucleotide sequence that encodes wild type *Thermoanaerobacter brockii* β-glucosidase (SEQ ID NO: 2), but which has been codon optimized to express well in *E. coli*. Other specific changes have been identified in polynucleotides of the present invention which differ from the corresponding wild type *T. brockii* β-glucosidase sequence. The present invention further provides an isolated or recombinant β-glucosidase polynucleotide having a polynucleotide sequence comprising one or more substitutions selected from the group consisting of t138c, c228a, t255a, a285g, t339c, c387t, a393t, a444t, t477a, a513g, t537a, g540a, c588t, c678t, t744c, g765a, a789g, t792c, t807c, c909t, c912t, a939g, t990c, t1032c, t1062c, a1089g, t1125a, t1128a, t1179c, a1269g, c1296t, t1302c, t1332c, where nucleotide position is determined by optimal alignment with SEQ ID NO: 1.

Polynucleotides of the present invention can be prepared using methods that are well known in the art. Typically, oligonucleotides of up to about 40 bases are individually synthesized, then joined (e.g., by enzymatic or chemical ligation methods, or polymerase-mediated methods) to form essentially any desired continuous sequence. For example, polynucleotides of the present invention can be prepared by chemical synthesis using, for example, the classical phosphoramidite method described by Beaucage, et al. (1981) *Tetrahedron Letters*, 22:1859-69, or the method described by Matthes, et al. (1984) *EMBO J.*, 3:801-05, both of which are incorporated herein by reference. These methods are typically practiced in automated synthetic methods. According to the phosphoramidite method, oligonucleotides are synthesized, e.g., in an automatic DNA synthesizer, purified, annealed, ligated and cloned in appropriate vectors.

In addition, essentially any nucleic acid can be custom ordered from any of a variety of commercial sources, such as The Midland Certified Reagent Company (Midland, Tex.), The Great American Gene Company (Ramona, Calif.), ExpressGen Inc. (Chicago, Ill.), Operon Technologies Inc. (Alameda, Calif.), and many others.

Polynucleotides may also be synthesized by well-known techniques as described in the technical literature. See, e.g., Carruthers, et al., *Cold Spring Harbor Symp. Quant. Biol.*, 47:411-418 (1982) and Adams, et al., *J. Am. Chem. Soc.*, 105:661 (1983), both of which are incorporated herein by reference. Double stranded DNA fragments may then be obtained either by synthesizing the complementary strand and annealing the strands together under appropriate conditions, or by adding the complementary strand using DNA polymerase with an appropriate primer sequence.

General texts which describe molecular biological techniques useful herein, including the use of vectors, promoters and many other relevant topics, include Berger and Kimmel, *Guide to Molecular Cloning Techniques, Methods in Enzymology volume* 152 Academic Press, Inc., San Diego, Calif. (Berger); Sambrook et al., *Molecular Cloning—A Laboratory Manual* (2nd Ed.), Vol. 1-3, Cold Spring Harbor Laboratory, Cold Spring Harbor, N.Y., 1989 ("Sambrook") and *Current Protocols in Molecular Biology*, F. M. Ausubel et al., eds., Current Protocols, a joint venture between Greene Publishing Associates, Inc. and John Wiley & Sons, Inc., (supplemented through 1999) ("Ausubel"), all of which are incorporated herein by reference. Examples of protocols sufficient to direct persons of skill through in vitro amplification methods, including the polymerase chain reaction (PCR) and the ligase chain reaction (LCR). Reference is made to Berger, Sambrook, and Ausubel, as well as Mullis et al., (1987) U.S. Pat. No. 4,683,202; *PCR Protocols A Guide to Methods and Applications* (Innis et al. eds) Academic Press Inc. San Diego, Calif. (1990) (Innis); Arnheim & Levinson (Oct. 1, 1990) C&EN 36-47; *The Journal Of NIH Research* (1991) 3, 81-94; (Kwoh et al. (1989) *Proc. Natl. Acad. Sci. USA* 86, 1173; Guatelli et al. (1990) *Proc. Natl. Acad. Sci. USA* 87, 1874; Lomell et al. (1989) *J. Clin. Chem.* 35, 1826; Landegren et al., (1988) *Science* 241, 1077-1080; Van Brunt (1990) *Biotechnology* 8, 291-294; Wu and Wallace, (1989) *Gene* 4, 560; Barringer et al. (1990) *Gene* 89, 117, and Sooknanan and Malek (1995) *Biotechnology* 13: 563-564, all of which are incorporated herein by reference. Improved methods for cloning in vitro amplified nucleic acids are described in Wallace et al., U.S. Pat. No. 5,426,039, which is incorporated herein by reference.

Exemplary β-glucosidase polynucleotides of the present invention include those corresponding to SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121 and/or 123. Each of these polynucleotides encode a polypeptide having the subsequent even number sequence identifier, for example the polynucleotide of SEQ ID NO: 3 encodes a polypeptide having SEQ ID NO: 4 and the polynucleotide of SEQ ID NO: 105 encodes a polypeptide having SEQ ID NO: 106.

Vectors, Promoters, and Expression Systems

The present invention also includes recombinant constructs comprising one or more of the β-glucosidase polynucleotide sequences as broadly described above. The term "construct", "DNA construct", or "nucleic acid construct" refers herein to a nucleic acid, either single- or double-stranded, which is isolated from a naturally occurring gene or which has been modified to contain segments of nucleic acids in a manner that would not otherwise exist in nature. The term "nucleic acid construct" is synonymous with the term "expression cassette" when the nucleic acid construct contains the control sequences required for expression of a β-glucosidase coding sequence of the present invention.

The present invention also provides an expression vector comprising a β-glucosidase polynucleotide of the present invention operably linked to a promoter. Example 1 provides a description of how to make constructs for expression of β-glucosidase. However, one skilled in the art is aware of means for making DNA constructs. The term "control sequences" refers herein to all the components that are necessary or advantageous for the expression of a polypeptide of the present invention. Each control sequence may be native or foreign to the nucleotide sequence encoding the polypeptide. Such control sequences include, but are not limited to, a leader, promoter, signal peptide sequence, and transcription terminator. At a minimum, the control sequences include a promoter and transcriptional and translational stop signals. In some embodiments, the control sequence may include a polyadenylation sequence. The control sequences may be provided with linkers for the purpose of introducing specific restriction sites facilitating ligation of the control sequences with the coding region of the nucleotide sequence encoding a polypeptide.

The term "operably linked" refers herein to a configuration in which a control sequence is appropriately placed at a position relative to the coding sequence of the DNA sequence such that the control sequence influences the expression of a polypeptide.

When used herein, the term "coding sequence" is intended to cover a nucleotide sequence, which directly specifies the amino acid sequence of its protein product. The boundaries of the coding sequence are generally determined by an open reading frame, which usually begins with the ATG start codon. The coding sequence typically includes a DNA, cDNA, and/or recombinant nucleotide sequence.

As used herein, the term "expression" includes any step involved in the production of the polypeptide including, but not limited to, transcription, post-transcriptional modification, translation, post-translational modification, and secretion.

The term "expression vector" refers herein to a DNA molecule, linear or circular, that comprises a segment encoding a polypeptide of the invention, and which is operably linked to additional segments that provide for its transcription.

Nucleic acid constructs of the present invention comprise a vector, such as, a plasmid, a cosmid, a phage, a virus, a bacterial artificial chromosome (BAC), a yeast artificial chromosome (YAC), or the like, into which a nucleic acid sequence of the invention has been inserted, in a forward or reverse orientation. In a preferred aspect of this embodiment, the construct further comprises regulatory sequences, including, for example, a promoter, operably linked to the sequence. Large numbers of suitable vectors and promoters are known to those of skill in the art, and are commercially available.

Polynucleotides of the present invention can be incorporated into any one of a variety of expression vectors suitable for expressing a polypeptide. Suitable vectors include chromosomal, nonchromosomal and synthetic DNA sequences, e.g., derivatives of SV40; bacterial plasmids; phage DNA; baculovirus; yeast plasmids; vectors derived from combinations of plasmids and phage DNA, viral DNA such as vaccinia, adenovirus, fowl pox virus, pseudorabies, adenovirus, adeno-associated virus, retroviruses and many others. Any vector that transduces genetic material into a cell, and, if replication is desired, which is replicable and viable in the relevant host can be used.

When incorporated into an expression vector, a polynucleotide of the invention is operatively linked to an appropriate transcription control sequence (promoter) to direct mRNA synthesis, e.g., T5 promoter. Examples of such transcription control sequences particularly suited for use in transgenic plants include the cauliflower mosaic virus (CaMV) and figwort mosaic virus (FMV). Other promoters known to control expression of genes in prokaryotic or eukaryotic cells or their viruses and which can be used in some embodiments of the invention include SV40 promoter, *E. coli* lac or trp promoter, phage lambda $P_L$ promoter, tac promoter, T7 promoter, and the like. Examples of suitable promoters useful for directing the transcription of the nucleotide constructs of the present invention in a filamentous fungal host cell are promoters such as cbh1, cbh2, egl1, egl2, pepA, hfb1, hfb2, xynl, amy, and glaA (Nunberg et al., *Mol. Cell. Biol.,* 4:2306-2315 (1984), Boel et al., EMBO J 3:1581-1585 ((1984) and EPA 137280, which are incorporated herein by reference). In bacterial host cells, suitable promoters include the promoters obtained from the *E. coli* lac operon, *Spreptomyces coelicolor* agarase gene (dagA), *Bacillus subtilis* levansucranse gene (sacB), *Bacillus licheniformis* alpha-amylase gene (amyl), *Bacillus stearothermophilus* maltogenic amylase gene (amyM), *Bacillus amyloliquefaciens* alpha-amylase gene (amyQ), *Bacillus subtilis* xylA and xylB genes and prokaryotic beta-lactamase gene. An expression vector optionally contains a ribosome binding site for translation initiation, and a transcription terminator, such as PinII. The vector also optionally includes appropriate sequences for amplifying expression, e.g., an enhancer.

The vector or DNA construct may also generally include a signal peptide coding region that codes for an amino acid sequence linked to the amino terminus of a polypeptide and which directs the encoded polypeptide into the cells secretory pathway. Using such constructs, the β-glucosidase polypeptide variants of the present invention can be secreted from the host cell in which they are expressed. Effective signal peptide coding regions for bacterial host cells may be obtained from the genes of *Bacillus* NCIB 11837 maltogenic amylase, *B. stearothermophilus* alpha-amylase, *B. licheniformis* subtilisin, *B. licheniformis* beta-lactamase, *B. stearothermophilus* neutral proteases (nprT, nprS, nprM) and *B. subtilis* prsS. Further signal sequences are described in Simonen and Palva (1993), *Microbiological Reviews* 57:109-137. Effective signal peptides coding regions for filamentous fungal host cells include but are not limited to the signal peptide coding regions obtained from *Aspergillus oryzae* TAKA amylase, *Aspergillus niger* neutral amylase, *Aspergillus niger* glucoamylase, *Rhizomucor miehei* asparatic proteinase, *Humicola insolens* cellulose, *Humicola lanuginosa* lipase, and *T. reesei* cellobiohydrolase II (TrCBH2). Useful signal peptides for yeast host cells also include those for the genes for *Saccharomyces cerevisiae* alpha-factor, *Saccharomyces cerevisiae* SUC2 invertase (see Taussig and Carlson, 1983, *Nucleic Acids Res.* 11:1943-54; SwissProt Accession No. P00724), and others. See, e.g., Romanos et al., 1992, *Yeast* 8:423-488. Variants of these signal peptides and other signal peptides are also suitable for use in the practice of the present invention.

In addition, the expression vectors of the present invention optionally contain one or more selectable marker genes to provide a phenotypic trait for selection of transformed host cells. Suitable marker genes include those coding for antibiotic resistance such as, ampicillin, kanamycin, chloramphenicol, or tetracycline resistance. Further examples include the antibiotic spectinomycin or streptomycin (e.g., the aada gene), the streptomycin phosphotransferase (SPT) gene coding for streptomycin resistance, the neomycin phosphotransferase (NPTII) gene encoding kanamycin or geneticin resistance, the hygromycin phosphotransferase (HPT) gene coding for hygromycin resistance. Additional selectable marker genes include dihydrofolate reductase or neomycin resistance for eukaryotic cell culture, and tetracycline or ampicillin resistance in *E. coli*.

An exemplary expression vector for the expression of β-glucosidase polypeptides of the present invention is depicted in FIG. 1. Vectors of the present invention can be employed to transform an appropriate host to permit the host to express an invention protein or polypeptide.

β-glucosidase polynucleotides of the invention can also be fused, for example, in-frame to nucleic acids encoding a secretion/localization sequence, to target polypeptide expression to a desired cellular compartment, membrane, or organelle of a cell, or to direct polypeptide secretion to the periplasmic space or into the cell culture media. Such sequences are known to those of skill, and include secretion leader peptides, organelle targeting sequences (e.g., nuclear localization sequences, endoplasmic reticulum (ER) retention signals, mitochondrial transit sequences, peroxisomal transit sequences, and chloroplast transit sequences), membrane localization/anchor sequences (e.g., stop transfer sequences, GPI anchor sequences), and the like.

Expression Hosts

The present invention also relates to engineered (recombinant) host cells that are transformed with a vector or DNA construct of the invention (e.g., an invention cloning vector or an invention expression vector), as well as the production of polypeptides of the invention. Thus, the present invention is directed to a host cell comprising any polynucleotide of the present invention that is described hereinabove. As used herein a genetically modified or recombinant host cell includes the progeny of said host cell that comprises a β-glucosidase polynucleotide which encodes a recombinant or variant polypeptide of the invention.

In some embodiments, the genetically modified or recombinant host cell is a eukaryotic cell. Suitable eukaryotic host cells include, but are not limited to, fungal cells, algal cells, insect cells, and plant cells. Suitable fungal host cells include, but are not limited to, Ascomycota, Basidiomycota, Deuteromycota, Zygomycota, Fungi imperfecti. Particularly preferred fungal host cells are yeast cells and filamentous fungal cells. The filamentous fungi host cells of the present invention include all filamentous forms of the subdivision Eumycotina and Oomycota. (Hawksworth et al., In Ainsworth and Bisby's Dictionary of The Fungi, $8^{th}$ edition, 1995, CAB International, University Press, Cambridge, UK). Filamentous fungi are characterized by a vegetative mycelium with a cell wall composed of chitin, cellulose and other complex polysaccharides. The filamentous fungi host cells of the present invention are morphologically distinct from yeast.

In the present invention a filamentous fungal host cell may be a cell of a species of but not limited to *Achlya, Acremonium, Aspergillus, Aureobasidium, Bjerkandera, Ceriporiopsis, Cephalosporium, Chrysosporium, Cochliobous, Corynascus, Cryphonectria, Cryptococcus, Coprinus, Coriolus, Dirdodia, Endothis, Fusarium, Gibberella, Gliocladiuin, Humcola, Hypocrea, Myceliophthora, Mucor, Neurospora, Penicillium, Podospora, Phlebia, Piromyces, Pyricularia, Rhizomucor, Rhizopus, Schizophyllum, Scytalidium, Sporotrichum, Talaromyces, Thermoascus, Thielavia, Trametes, Tolypocladium, Trichoderma, Verticillium; Volvariella*, or teleomorphs, or anamorphs, and synonyms or taxonomic equivalents thereof.

In some embodiments of the invention, the filamentous fungal host cell is of the, *Aspergillus* species, *Ceriporiopsis* species, *Chrysosporium* species, *Corynascus* species, *Fusarium* species, *Humicola* species, *Myceliophthora*, *Neurospora* species, *Penicillum* species, *Tolypocladium* species, *Tramates* species, or *Trichoderma* species.

In some embodiments of the invention, the filamentous fungal host cell is of the *Trichoderma* species, e.g., *T. longibrachiatum, T. viride* (e.g., ATCC 32098 and 32086), *Hypocrea jecorina* or *T. reesei* (NRRL 15709, ATTC 13631, 56764, 56765, 56466, 56767 and RL-P37 and derivatives thereof—See Sheir-Neiss et al, *Appl. Microbiol. Biotechnology*, 20 (1984) pp 46-53), *T. koningii*, and *T. harzianum*. In addition, the term "*Trichoderma*" refers to any fungal strain that was previously classified as *Trichoderma* or currently classified as *Trichoderma*.

In some embodiments of the invention, the filamentous fungal host cell is of the *Aspergillus* species, e.g., *A. awamori, A. funigatus, A japonicus, A. nidulans, A. niger, A. aculeatus, A. foetidus, A. oryzae, A. sojae*, and *A. kawachi*. (Reference is made to Kelly and Hynes (1985) *EMBO J.* 4, 475479; NRRL 3112, ATCC 11490, 22342, 44733, and 14331; Yelton M., et al., (1984) *Proc. Natl. Acad. Sci. USA*, 81, 1470-1474; Tilburn et al., (1982) *Gene* 26, 205-221; and Johnston, I. L. et al. (1985) *EMBO J.* 4, 1307-1311).

In some embodiments of the invention, the filamentous fungal host cell is of the *Chrysosporium* species, e.g., *C. lucknowense, C. keratinophilum, C. tropicum, C. merdarium, C. inops, C. pannicola*, and *C. zonatum*.

In some embodiments of the invention, the filamentous fungal host cell is of the *Fusarium* species, e.g., *F. bactridioides, F. cerealis, F. crookwellense, F. culmorum, F. graminearum, F. graminum. F. oxysporum, F. roseum*, and *F. venenatum*.

In some embodiments of the invention, the filamentous fungal host cell is of the *Neuraspora* species, e.g., *N. crassa*. Reference is made to Case, M. E. et al., (1979) *Proc. Natl. Acad. Sci. USA*, 76, 5259-5263; U.S. Pat. No. 4,486,553; and Kinsey, J. A. and J. A. Rambosek (1984) *Molecular and Cellular Biology* 4, 117-122.

In some embodiments of the invention, the filamentous fungal host cell is of the *Humicola* species, e.g., *H. insolens*, *H. grisea*, and *H. lanuginosa*. In some embodiments of the invention, the filamentous fungal host cell is of the *Mucor* species, e.g., *M. miechei* and *M. circinelloides*, or of the *Myceliophthora* species, e.g., *M. thermophila*. In some embodiments of the invention, the filamentous fungal host cell is of the *Rhizopus* species, e.g., *R. oryzae* and *R. niveus*. In some embodiments of the invention, the filamentous fungal host cell is of the *Penicillum* species, e.g., *P. purpurogenum*, *P. chrysogenum*, and *P. verruculosum*. In some embodiments of the invention, the filamentous fungal host cell is of the *Thielavia* species. e.g., *T. terrestris*. In some embodiments of the invention, the filamentous fungal host cell is of the *Tolypocladium* species, e.g., *T. inflatum* and *T. geodes*. In some embodiments of the invention, the filamentous fungal host cell is of the *Trametes* species, e.g., *T. villosa* and *T. versicolor*.

In the present invention, a yeast host cell may be a cell of a species of, but not limited to *Candida, Hansenula, Saccharomyces, Schizosaccharomyces, Pichia, Kluyveromyces*, and *Yarrowia*. In some embodiments of the invention, the yeast cell is *Hansenula polymorpha, Saccharomyces cerevisiae, Saccaromyces carlsbergensis, Saccharomyces diastaticus, Saccharomyces norbensis, Saccharomyces kluyveri, Schizosaccharomyces pombe, Pichia pastoris, Pichia finlandica, Pichia trehalophila, Pichia kodamae, Pichia membranaefaciens, Pichia opuntiae, Pichia thermotolerans, Pichia salictaria, Pichia quercuum, Pichia pijperi, Pichia stipitis, Pichia methanolica, Pichia angusta, Kluyveromyces lactis, Candida albicans*, and *Yarrowia lipolytica*.

In some embodiments on the invention, the host cell is an algal such as, *Chlamydomonas* (e.g., *C. Reinhardtii*) and *Phormidium* (P. sp. ATCC29409).

In other embodiments, the host cell is a prokaryotic cell. Suitable prokaryotic cells include gram positive, gram negative and gram-variable bacterial cells. The host cell may be a species of, but not limited to *Agrobacterium, Alicyclobacillus, Anabaena, Anacystis, Acinetobacter, Acidothermus, Arthrobacter, Azobacter, Bacillus, Bifidobacterium, Brevibacterium, Butyrivibrio, Buchnera, Campestris, Camplyobacter, Clostridium, Corynebacterium, Chromatium, Coprococcus, Escherichia, Enterococcus, Enterobacter, Erwinia, Fusobacterium, Faecalibacterium, Francisella, Flavobacterium, Geobacillus, Haemophilus, Helicobacter, Klebsiella, Lactobacillus, Lactococcus, Ilyobacter, Micrococcus, Microbacterium, Mesorhizobium, Methylobacterium, Methylobacterium, Mycobacterium, Neisseria, Pantoea, Pseudomonas, Prochlorococcus, Rhodobacter, Rhodopseudomonas, Rhodopseudomonas, Roseburia, Rhodospirillum, Rhodococcus, Scenedesmus, Streptomyces, Streptococcus, Synecoccus, Saccharomonospora, Staphylococcus, Serratia, Salmonella, Shigella, Thermoanaerobacterium, Tropheryma, Tularensis, Temecula, Thermosynechococcus, Thermococcus, Ureaplasma, Xanthomonas, Xylella, Yersinia* and *Zymomonas*.

In some embodiments, the host cell is a species of *Agrobacterium, Acinetobacter, Azobacter, Bacillus, Bifidobacterium, Buchnera, Geobacillus, Campylobacter, Clostridium, Corynebacterium, Escherichia, Enterococcus, Erwinia, Flavobacterium, Lactobacillus, Lactococcus, Pantoea, Pseudomonas, Staphylococcus, Salmonella, Streptococcus, Streptomyces*, and *Zymomonas*.

In yet other embodiments, the bacterial host strain is non-pathogenic to humans. In some embodiments the bacterial host strain is an industrial strain. Numerous bacterial industrial strains are known and suitable in the present invention.

In some embodiments of the invention the bacterial host cell is of the *Agrobacterium* species, e.g., *A. radiobacter, A. rhizogenes*, and *A. rubi*. In some embodiments of the invention the bacterial host cell is of the *Arthrobacter* species, e.g., *A. aurescens, A. citreus, A. globformis, A. hydrocarboglutamicus, A. mysorens, A. nicotianae, A. paraffineus, A. protophonniae, A. roseopareinus, A. sulfitreus*, and *A. urealaciens*. In some embodiments of the invention the bacterial host cell is of the *Bacillus* species, e.g., *B. thuringiensis, B. anthracis, B. megaterium, B. subtilis, B. lentus, B. circulans, B. pumilus, B. lautus, B. coagulans, B. brevis, B. firmus, B. alkaophius, B. lichemformis, B. clausii, B. stearothermophilus, B. halodurans* and *B. amyloliquefaciens*. In particular embodiments, the host cell will be an industrial *Bacillus* strain including but not limited to *B. subtilis, B. pumilus, B. licheniformis, B. megaterium, B. clausii, B. stearothermophilus* and *B. amyloliquefaciens*. Some preferred embodiments of a *Bacillus* host cell include *B. subtilis, B. licheniformis, B. megaterium, B, stearothermophilus* and *B. amyloliquefixciens*. In some embodiments the bacterial host cell is of the *Clostridium* species, e.g., *C. acetobutylicum, C. tetani* E88, *C. lituseburense, C. saccharobutylicum, C. perfringens*, and *C. beijerinckii*. In some embodiments the bacterial host cell is of the *Corynebacterium* species e.g., *C. glutamicum* and *C. acetoacidophilum*. In some embodiments the bacterial host cell is of the *Escherichia* species, e.g., *E. coli*. In some embodiments the bacterial host cell is of the *Erwinia* species, e.g., *E. uredovora, E. carotovora, E. ananas, E. herbicola, E. punctata*, and *E. terreus*. In some embodiments the bacterial host cell is of the *Pantoea* species, e.g., *P. citrea*, and *P. agglomerans*. In some embodiments the bacterial host cell is of the *Pseudomonas* species, e.g., *P. putida, P. aeruginosa, P. mevalonii*, and *P.* sp. D-01 10. In some embodiments the bacterial host cell is of the *Streptococcus* species, e.g., *S. equisimiles, S. pyogenes*, and *S. uberis*. In some embodiments the bacterial host cell is of the *Streptomyces* species, e.g., *S. ambofaciens, S. achromogenes, S. avermitilis, S. coelicolor, S. aureofaciens, S. aureus, S. fungicidicus, S. griseus*, and *S. lividans*. In some embodiments the bacterial host cell is of the *Zymomonas* species, e.g., *Z. mobilis*, and *Z. lipoiytica*.

Strains which may be used in the practice of the invention including both prokaryotic and eukaryotic strains, are readily accessible to the public from a number of culture collections such as American Type Culture Collection (ATCC), Deutsche Sammlung von Mikroorganismen and Zellkulturen GmbH (DSM), Centraalbureau Voor Schimmelcultures (CBS), and Agricultural Research Service Patent Culture Collection, Northern Regional Research Center (NRRL).

Introduction of a vector or DNA construct into a host cell can be effected by calcium phosphate transfection, DEAE-Dextran mediated transfection, electroporation, or other common techniques (See Davis, L., Dibner, M. and Battey, I. (1986) *Basic Methods in Molecular Biology*, which is incorporated herein by reference). The engineered host cells can be cultured in conventional nutrient media modified as appropriate for activating promoters, selecting transformants, or amplifying the β-glucosidase polynucleotide. Culture conditions, such as temperature, pH and the like, are those previously used with the host cell selected for expression, and will be apparent to those skilled in the art and in the references cited herein, including, for example, Sambrook, Ausubel and Berger, as well as, for example, Freshney (1994) *Culture of Animal Cells, a Manual of Basic Technique*, third edition, Wiley-Liss, New York; Payne et al. (1992) *Plant Cell and Tissue Culture in Liquid Systems* John Wiley & Sons, Inc. New York, N.Y.; Gamborg and Phillips (eds) (1995) *Plant Cell, Tissue and Organ Culture*; Fundamental Methods Springer Lab Manual, Springer-Verlag (Berlin Heidelberg New York) and Atlas and Parks (eds) *The Handbook of Microbiological Media* (1993) CRC Press, Boca Raton, Fla., all of which are incorporated herein by reference.

Production and Recovery of β-Glucosidase Polypeptides

The present invention is directed to a method of making a polypeptide having β-glucosidase activity, the method comprising providing a host cell transformed with any one of the described β-glucosidase polynucleotides of the present invention; culturing the transformed host cell in a culture medium under conditions that cause said polynucleotide to express the encoded β-glucosidase polypeptide; and optionally recovering or isolating the expressed β-glucosidase polypeptide. The present invention further provides a method of making a β-glucosidase polypeptide, said method comprising cultivating a host cell transformed with a β-glucosidase polynucleotide under conditions suitable for the production of the β-glucosidase polypeptide and recovering the β-glucosidase polypeptide.

Typically, recovery or isolation of the β-glucosidase polypeptide is from the host cell culture medium, the host cell or both, using protein recovery techniques that are well known in the art, including those described herein.

Following transformation of a suitable host strain and growth (cultivating or culturing) of the host strain to an appropriate cell density, the selected promoter may be induced by appropriate means (e.g., temperature shift or chemical induction) and cells are cultured for an additional period. Cells are typically harvested by centrifugation, disrupted by physical or chemical means, and the resulting crude extract may be retained for further purification. Microbial cells employed in expression of proteins can be disrupted by any convenient method, including freeze-thaw cycling, sonication, mechanical disruption, or use of cell lysing agents, or other methods, which are well known to those skilled in the art.

As noted, many references are available for the culture and production of many cells, including cells of bacterial, plant, animal (especially mammalian) and archebacterial origin. See e.g., Sambrook, Ausubel, and Berger (all supra), as well as Freshney (1994) *Culture of Animal Cells, a Manual of Basic Technique*, third edition, Wiley-Liss, New York and the references cited therein; Doyle and Griffiths (1997) *Mammalian Cell Culture: Essential Techniques* John Wiley and Sons, NY; Humason (1979) *Animal Tissue Techniques*, fourth edition W.H. Freeman and Company; and Ricciardelli, et al., (1989) *In vitro Cell Dev. Biol.* 25:1016-1024, all of which are incorporated herein by reference. For plant cell culture and regeneration, Payne et al. (1992) *Plant Cell and Tissue Culture in Liquid Systems* John Wiley & Sons, Inc. New York, N.Y.; Gamborg and Phillips (eds) (1995) *Plant Cell, Tissue and Organ Culture*; Fundamental Methods Springer Lab Manual, Springer-Verlag (Berlin Heidelberg New York); Jones, ed. (1984) *Plant Gene Transfer and Expression Protocols*, Humana Press, Totowa, N.J. and *Plant Molecular Biology* (1993) R. R. D. Croy, Ed. Bios Scientific Publishers, Oxford, U.K. ISBN 0 12 198370 6, all of which are incorporated herein by reference. Cell culture media in general are set forth in Atlas and Parks (eds.) *The Handbook of Microbiological Media* (1993) CRC Press, Boca Raton, Fla., which is incorporated herein by reference. Additional information for cell culture is found in available commercial literature such as the Life Science Research Cell Culture Catalogue (1998) from Sigma-Aldrich, Inc (St Louis, Mo.) ("Sigma-LSRCCC") and, for example, *The Plant Culture Catalogue* and supplement (1997) also from Sigma-Aldrich, Inc (St Louis, Mo.) ("Sigma-PCCS"), all of which are incorporated herein by reference.

In some embodiments, cells expressing the β-glucosidase polypeptides of the invention are grown under batch or continuous fermentations conditions. Classical batch fermentation is a closed system, wherein the compositions of the medium is set at the beginning of the fermentation and is not subject to artificial alternations during the fermentation. A variation of the batch system is a fed-batch fermentation which also finds use in the present invention. In this variation, the substrate is added in increments as the fermentation progresses. Fed-batch systems are useful when catabolite repression is likely to inhibit the metabolism of the cells and where it is desirable to have limited amounts of substrate in the medium. Batch and fed-batch fermentations are common and well known in the art. Continuous fermentation is an open system where a defined fermentation medium is added continuously to a bioreactor and an equal amount of conditioned medium is removed simultaneously for processing. Continuous fermentation generally maintains the cultures at a constant high density where cells are primarily in log phase growth. Continuous fermentation systems strive to maintain steady state growth conditions. Methods for modulating nutrients and growth factors for continuous fermentation processes as well as techniques for maximizing the rate of product formation are well known in the art of industrial microbiology.

The resulting polypeptide may be recovered/isolated and optionally purified by any of a number of methods known in the art. For example, the polypeptide may be isolated from the nutrient medium by conventional procedures including, but not limited to, centrifugation, filtration, extraction, spray-drying, evaporation, chromatography (e.g., ion exchange, affinity, hydrophobic, chromatofocusing, and size exclusion), or precipitation. Protein refolding steps can be used, as desired, in completing the configuration of the mature protein. Finally, high performance liquid chromatography (HPLC) can be employed in the final purification steps. In addition to the references noted supra, a variety of purification methods are well known in the art, including, for example, those set forth in Sandana (1997) *Bioseparation of Proteins*, Academic Press, Inc.; Bollag et al. (1996) *Protein Methods*, $2^{nd}$ Edition, Wiley-Liss, NY; Walker (1996) *The Protein Protocols Handbook* Humana Press, NJ; Harris and Angal (1990) *Protein Purification Applications: A Practical Approach*, IRL Press at Oxford, Oxford, England; Harris and Angal *Protein Purification Methods: A Practical Approach*, IRL Press at Oxford, Oxford, England; Scopes (1993) *Protein Purification: Principles and Practice $3^{rd}$ Edition*, Springer Verlag, NY; Janson and Ryden (1998) *Protein Purification: Principles, High Resolution Methods and Applications, Second Edition*, Wiley-VCH, NY; and Walker (1998) *Protein Protocols on CD-ROM*, Humana Press, NJ, all of which are incorporated herein by reference.

A procedure for recovering the β-glucosidase polypeptide from a cell lysate is illustrated in Example 2.

Cell-free transcription/translation systems can also be employed to produce β-glucosidase polypeptides using the polynucleotides of the present invention. Several such systems are commercially available. A general guide to in vitro transcription and translation protocols is found in Tymms (1995) *In vitro Transcription and Translation Protocols: Methods in Molecular Biology*, Volume 37, Garland Publishing, NY, which is incorporated herein by reference.

Methods of Using β-Glucosidase Polypeptides and Related Compositions

As described supra, β-glucosidase polypeptides of the present invention can be used to catalyze the hydrolysis of a sugar dimer with the release of the corresponding sugar monomer, for example the conversion of cellobiose with the release of glucose. Thus, the present invention provides a method for producing glucose, said method comprising: (a) providing a cellobiose and (b) contacting the cellobiose with a β-glucosidase polypeptide of the invention under conditions sufficient to form a reaction mixture for converting the cellobiose to glucose. The β-glucosidase polypeptide variant may be utilized in such methods in either isolated form or as part of a composition, such as any of those described herein. The β-glucosidase polypeptide variant may also be provided in cell culturing media or in a cell lysate. For example, after producing the β-glucosidase polypeptide variant by culturing a host cell transformed with a β-glucosidase polynucleotide or vector of the present invention, k the β-glucosidase need not be isolated from the culture medium (i.e., if the β-glucosidase is secreted into the culture medium) or cell lysate (i.e., if the β-glucosidase is not secreted into the culture medium) or used in purified form to be useful in further methods of using the β-glucosidase polypeptide variant. Any composition, cell culture medium or cell lysate containing a β-glucosidase polypeptide variant of the present invention may be suitable for using in methods that utilize a β-glucosidase. Therefore, the present invention further provides a method for producing glucose, the method comprising: (a) providing a cellobiose; and (b) contacting the cellobiose with a culture medium or cell lysate or composition comprising a β-glucosidase polypeptide variant of the present invention under conditions sufficient to form a reaction mixture for converting the cellobiose to glucose.

The present invention further provides compositions that are useful for the enzymatic conversion of cellobiose to glucose. For example, one or more β-glucosidase polypeptide variants of the present invention may be combined with another enzyme and/or an agent that alters the bulk material handling properties or further processability of the β-glucosidase(s) (e.g., a flow aid agent, water, buffer, a surfactant, and the like) or that improves the efficiency of the conversion of cellobiose to glucose, as described in more detail hereinbelow. The other enzyme may be a different β-glucosidase or another cellulase enzyme. For example, in some embodiments, the β-glucosidase is combined with other cellulases to form a cellulase mixture. The cellulase mixture may include cellulases selected from CBH and EG cellulases (e.g., cellulases from *Trichoderma reesei* (e.g., C2730 Cellulase from *Trichoderma reesei* ATCC No. 25921, Sigma-Aldrich, Inc.), C9870 ACCELLERASE™ 1500, Genencor, Inc., and the like), *Acidothermus cellulolyticus*, *Thermobifida fusca*, *Humicola grisea* and *Chrysosporium* sp.). The enzymes of the cellulase mixture work together resulting in decrystallization and hydrolysis of the cellulose from a biomass substrate to yield soluble sugars, such as but not limited to glucose (Brigham et al., (1995) in Handbook on Bioethanol (C. Wyman ed.) pp 119-141, Taylor and Francis, Washington D.C.).

β-glucosidase polypeptide variants of the present invention may be used in combination with other optional ingredients such as a buffer, a surfactant, and/or a scouring agent. A buffer may be used with a β-glucosidase polypeptide variant of the present invention (optionally combined with other cellulases, including another β-glucosidase) to maintain a desired pH within the solution in which the β-glucosidase is employed. The exact concentration of buffer employed will depend on several factors which the skilled artisan can determine. Suitable buffers are well known in the art. A surfactant may further be used in combination with the cellulases of the present invention. Suitable surfactants include any surfactant compatible with the β-glucosidase and optional other cellulases being utilized. Exemplary surfactants include an anionic, a non-ionic, and an ampholytic surfactant.

Suitable anionic surfactants include, but are not limited to, linear or branched alkylbenzenesulfonates; alkyl or alkenyl ether sulfates having linear or branched alkyl groups or alkenyl groups; alkyl or alkenyl sulfates; olefinsulfonates; alkanesulfonates, and the like. Suitable counter ions for anionic surfactants include, for example, alkali metal ions, such as sodium and potassium; alkaline earth metal ions, such as calcium and magnesium; ammonium ion; and alkanolamines having from 1 to 3 alkanol groups of carbon number 2 or 3. Ampholytic surfactants suitable for use in the practice of the present invention include, for example, quaternary ammonium salt sulfonates, betaine-type ampholytic surfactants, and the like. Suitable nonionic surfactants generally include polyoxalkylene ethers, as well as higher fatty acid alkanolamides or alkylene oxide adduct thereof, fatty acid glycerine monoesters, and the like. Mixtures of surfactants can also be employed as is known in the art.

The β-glucosidase polypeptide variants of the present invention and compositions thereof may be used in the production of monosaccharides, disaccharides or polysaccharides as chemical or fermentation feedstock from biomass. Biomass may be any carbon containing substrate including cellulose and starch substrates. Therefore, the present invention provides a method of converting a biomass substrate to a fermentable sugar, the method comprising contacting a β-glucosidase polypeptide of the present invention or composition, culture medium or cell lysate containing a β-glucosidase polypeptide variant of the present invention, with the biomass substrate under conditions suitable for the production of the fermentable sugar. The present invention further provides a method of converting a biomass substrate to a fermentable sugar, the method comprising: (a) pretreating a cellulose substrate to increase its susceptibility to hydrolysis; (b) contacting the pretreated cellulose substrate of step (a) with a β-glucosidase polypeptide variant of the present invention or composition, culture medium or cell lysate containing a β-glucosidase polypeptide variant of the present invention under conditions suitable for the production of the fermentable sugar.

In some embodiments, the biomass includes cellulosic substrates including but not limited to, wood, wood pulp, paper pulp, corn stover, corn fiber, rice, paper and pulp processing waste, woody or herbaceous plants, fruit or vegetable pulp, distillers grain, grasses, rice hulls, wheat straw, cotton, hemp, flax, sisal, corn cobs, sugar cane bagasse, switch grass and mixtures thereof. The biomass may optionally be pretreated using methods known in the art such as chemical, physical and biological pretreatments (e.g., steam explosion, pulping, grinding, acid hydrolysis and combinations thereof). In some embodiments, the biomass comprises transgenic plants that express ligninase and/or cellulose enzymes which degrade ligning and cellulose. See, e.g., US 20080104724, which is incorporated herein by reference.

In some embodiments the β-glucosidase polypeptide variant and β-glucosidase polypeptide variant-containing compositions, cell culture media, and cell lysates may be reacted with the biomass in the range of about 25° C. to 100° C., about 30° C. to 90° C., about 30° C. to 80° C., about 30° C. to 70° C., about 40° C. to about 80° C. and about 35° C. to about 75° C. Also the biomass may be reacted with the β-glucosidase enzyme compositions at about 25° C., at about 30° C., at about 35° C., at about 40° C., at about 45° C., at about 50° C., at about 55° C., at about 60° C., at about 65° C., at about 70° C., at about 75° C., at about 80° C., at about 85° C., at about 90° C., at about 95° C. and at about 100° C. In addition to the temperatures described above, conditions suitable for converting a biomass substrate to a fermentable sugar that employ a β-glucosidase polypeptide variant of the present invention (optionally in a composition, cell culture medium, or cell lysate) include carrying out the process at a pH in the range from about pH 3.0 to 8.5, pH 3.5 to 8.5, pH 4.0 to 7.5, pH 4.0 to 7.0 and pH 4.0 to 6.5. Those having ordinary skill in the art will appreciate that the reaction times for converting a particular biomass substrate to a fermentable sugar may vary but the optimal reaction time can be readily determined. The incubation time may, for example, be in the range of from 1.0 to 240 hours, from 5.0 to 180 hrs and from 10.0 to 150 hrs. For example the incubation time will be at least 1 hr, at least 5 hrs, at least 10 hrs, at least 15 hrs, at least 25 hrs, at least 50 hr, at least 100 hrs, at least 180 and the like).

Incubation of the β-glucosidase with biomass substrate or pretreated biomass substrate under these conditions may result in the release of substantial amounts of the soluble sugars from the substrate. For example at least 20%, at least 30%, at least 40%, at least 50%, at least 60%, at least 70%, at least 80%, at least 90% or more soluble sugar may be available as compared to the release of sugar by a parent polypeptide and particularly the polypeptide of SEQ ID NO: 2. In some embodiments, the soluble sugars will be comprise glucose.

The soluble sugars produced by the methods of the invention may be used in the production of other end-products such as but not limited to alcohols (e.g., ethanol and butanol), acetone, amino acids (e.g., glycine and lysine), organic acids (e.g., lactic acid), glycerol, 1,3 propanediol, butanediol and animal feeds. The present invention therefore provides a method of producing an alcohol, where the method comprises (a) providing a fermentable sugar, such as one produced using a β-glucosidase polypeptide variant of the present invention in the methods described supra; (b) contacting the fermentable sugar with a fermenting microorganism to produce the alcohol; and (c) recovering the alcohol.

In some embodiments, the β-glucosidase compositions of the invention may be used simultaneously in a fermentation with a fermenting microorganism such as yeast (e.g., Saccharomyces sp., such as, for example, S. cerevisaie, Pichia sp., and the like) or other C5 or C6 fermenting microorganisms that are well known in the art, to produce an end-product such as ethanol. In a simultaneous saccharification and fermentation (SSF) process the fermentable sugars (e.g., glucose) are removed from the system by the fermentation.

One of skill in the art will readily appreciate that the β-glucosidase polypeptide variant compositions of the present invention may be used in the form of an aqueous solution or a solid concentrate. When aqueous solutions are employed, the β-glucosidase solution can easily be diluted to provide accurate concentrations. A concentrate can be in any form recognized in the art including, for example, liquids, emulsions, suspensions, gel, pastes, granules, powders, an agglomerate, a solid disk, as well as other forms that are well known in the art. Other materials can also be used with or included in the β-glucosidase composition of the present invention as desired, including stones, pumice, fillers, solvents, enzyme activators, and anti-redeposition agents depending on the intended use of the composition.

In addition, β-glucosidase compositions may be used in the food and beverage industry for example in the process of wine making for the efficient release of monoterpenols (see, for example, Yanai and Sato (1999) *Am. J. Enol. Eitic.*, 50:231-235, which is incorporated herein by reference) and for the preparation of glycon isoflavone-enriched tofu (see, for example, Mase et al., (2004) *J. Appl. Glycosci.*, 51:211-216, which is incorporated herein by reference). β-glucosidases are known to be useful in detergent compositions for improved cleaning performance (see, for example, U.S. Pat. No. 7,244,605; U.S. Pat. No. 5,648,263 and WO 2004/048592, which are incorporated herein by reference).

The foregoing and other aspects of the invention may be better understood in connection with the following non-limiting examples.

EXAMPLES

Example 1

Wild-Type *T. brockii* cglT Gene Acquisition and Construction of Expression Vector The cglT gene was designed for expression in *E. coli* and *Bacillus megaterium* based on the reported amino acid sequence (Breves et al., 1997. *Appl. Environmental Microbiol.* 63:3902) and using standard codon-optimization methods. (See, e.g., "OPTIMIZER: a web server for optimizing the codon usage of DNA sequences," Puigbò et al., *Nucleic Acids Res.* (2007 July); 35 (Sub server issue): W126-31, Epub 2007 Apr. 16, which is incorporated herein by reference.) Since codon usage in *E. coli* and *B. megaterium* is similar, an *E. coli* codon bias table was used. The exception was made for CTG codon (Leu); this codon is most frequently used in *E. coli*, but it is a rare codon in *B. megaterium*. It was replaced with ATT (Leu). The gene was synthesized by Gene Oracle, Inc, (Mountain View Calif.) as per the designed sequence provided, with restriction sites for cloning into *E. coli* vector pCK 110900, which is depicted in FIG. 1. Nucleotide sequences for SfiI sites were added to the 5' end and 3' end of the gene as well as the strong t7g10 RBS added in front of the ATG start codon.

The following restriction sites were excluded from the sequence: SfiI, BglI, NgoMIV, and SpeI. The gene was cloned into the pGOv3 vector by Gene Oracle (Mountain View, Calif.) and the sequence of the gene was verified.

For expression in *E. coli*, the cglT gene was subcloned into pCK11900 vector under the control of a lac promoter. The expression vector also contained the P15a origin of replication and the chloramphenicol resistance gene. The resulting plasmids were transformed into an *E. coli* W3110I derived strain.

Sequences from the transformants were verified, and β-glucosidase activity was verified on an agar plate containing 50 µg/ml X-glucoside (5-bromo-4-chloro-3-indolyl-β-D-glucopyranoside; Sigma, St. Louis, Mo.) where blue color production by the colonies indicated the production of an active β-glucosidase. X-glucoside is a substrate for β-glucosidase. A colony producing an active β-glucosidase will turn a blue color as a result of the released chromophore when the X-glucoside is hydrolyzed. The sequence of the codon optimized gene is provide in FIG. 2 (SEQ ID NO: 1) and the corresponding polypeptide sequence is designated SEQ ID NO: 2 (see above). The activity of the wild-type enzyme was confirmed as described below in Example 3.

Example 2

Production of β-Glucosidase Powders; Shake Flask Procedure

A single microbial colony of *E. coli* containing a plasmid with the cglT gene was inoculated into 5 ml LB (Luria Broth)

containing 30 μg/ml chloramphenicol and 1% glucose. Cells were grown overnight (at least 16 hrs) in an incubator at 30° C. with shaking at 250 rpm.

The culture was diluted into 250 ml 2XYT (Yeast Extract Tryptone; Difco reference 244020), and/or TB (Terrific Broth; Difco reference 243820) in 1 liter flask to an optical density at 600 nm ($OD_{600}$) of 0.2 and allowed to grow at 30° C. while shaking at 250 rpm. Expression of the cglT gene was induced with 1 mM IPTG when the OD600 of the culture was 0.6 to 0.8 and incubated overnight (at least 16 hrs). Cells were harvested by centrifugation (5000 rpm, 20 min, 4° C.) and the supernatant discarded. The cell pellet was re-suspended with 5 mL of cold (4° C.) 50 mM sodium phosphate buffer, pH 7, and harvested by centrifugation as above. The washed cells were re-suspended in two volumes of the final cell pellet weight of cold 50 mM sodium phosphate buffer, pH 7, and passed through a French Press twice at 15,000 psi while maintained at 4° C. Cell debris was removed by centrifugation (10,000 rpm, 30 min., 4° C.). The clear lysate supernatant was collected and stored at −20° C. Subsequent lyophilization of frozen clear lysate provided a dry powder of crude CglT enzyme.

The activity of the wild-type CglT was confirmed as described in accordance with the method described in Breves et al. (1997) *Appl. Environmental Microbiol.* 63:3902, which is incorporated herein by reference.

Example 3

Assays to Determine β-Glucosidase Activity

A. Para-Nitrophenyl Glucoside (pNPG) Assay

In a total volume of 100 μA, 30 μl lysate from Example 2 was added to 4 mM pNPG (Fluka) in a solution containing 25 mM sodium acetate, pH 5. The reaction was shaken for 30 min at 50° C. and subsequently 100 μA of 2 M $KCO_3$ was added to terminate the reaction. The liberated p-nitrophenyl was measured spectrophotometrically at 405 nm with a Spectramase 190, Molecular Devices, Sunnyvale, Calif. and the amount of released p-nitrophenyl was calculated from absorbance at 405 nm. See Breves, et al (1997), *Appl. Environmental Microbiol.* 63:3902.

Results of the reaction of the wild-type enzyme indicated an absorbance level of 4.0, which is indicative of a saturating activity level. In contrast, the negative control, an *E. coli* transformed with an empty vector, produced an absorbance of 0.0-0.5 under the same reaction conditions. Results obtained for cultures grown on both 2XYT and TB at both 23° C. and 30° C. were similar. All samples were analyzed in triplicates (results not shown).

B. Cellobiose Assay

Activity on substrate cellobiose was determined using a reaction mixture of a 100 μA volume containing 40 μA enzyme solution, 10 μA cellobiose stock solution (100 g/L solution; final concentration 10 g/L cellobiose (Fluka Cat. No. 22150) in reaction and 25 mM sodium acetate, pH 5. The reactions were incubated 50° C. for an appropriate time (25 minutes to overnight depending on the enzyme concentration) while shaking, quenched with equal volume of acetonitrile and mixed well by gentle inversions. The reaction was then centrifuged at 4000 rpm (Centrifuge Model No. 5810R (15 amps), Eppendorf North America, Westbury, N.Y.) for 5 minutes. 150 μl of the reaction was then filtered through a 0.4 μm filter (filter plates were used) through centrifugation at 2000 rpm (Centrifuge Model No. 5810R (15 amps), Eppendorf North America, Westbury, N.Y.)) for 3 min. Glucose production and/or cellobiose depletion was tracked through HPLC analysis using a Phenomenex® Rezex RHM-monosaccharide 150*7.8 mm (005-0132-KO) HPLC with guard column (Phenomenex, Inc., Torrance, Calif.). The mobile phase that was used was water at a flow rate of 1 ml/min. The column was used at a temperature of 50° C., typical sample injection volume was 20 μl, and run time was 3.8-4 min. Peak areas were quantified according to calibration curves with glucose and cellobiose as standards in the range of 1-73 mM. Typical retention time observed for cellobiose and glucose were 2.85 and 3.5 min., respectively.

Figure 3:
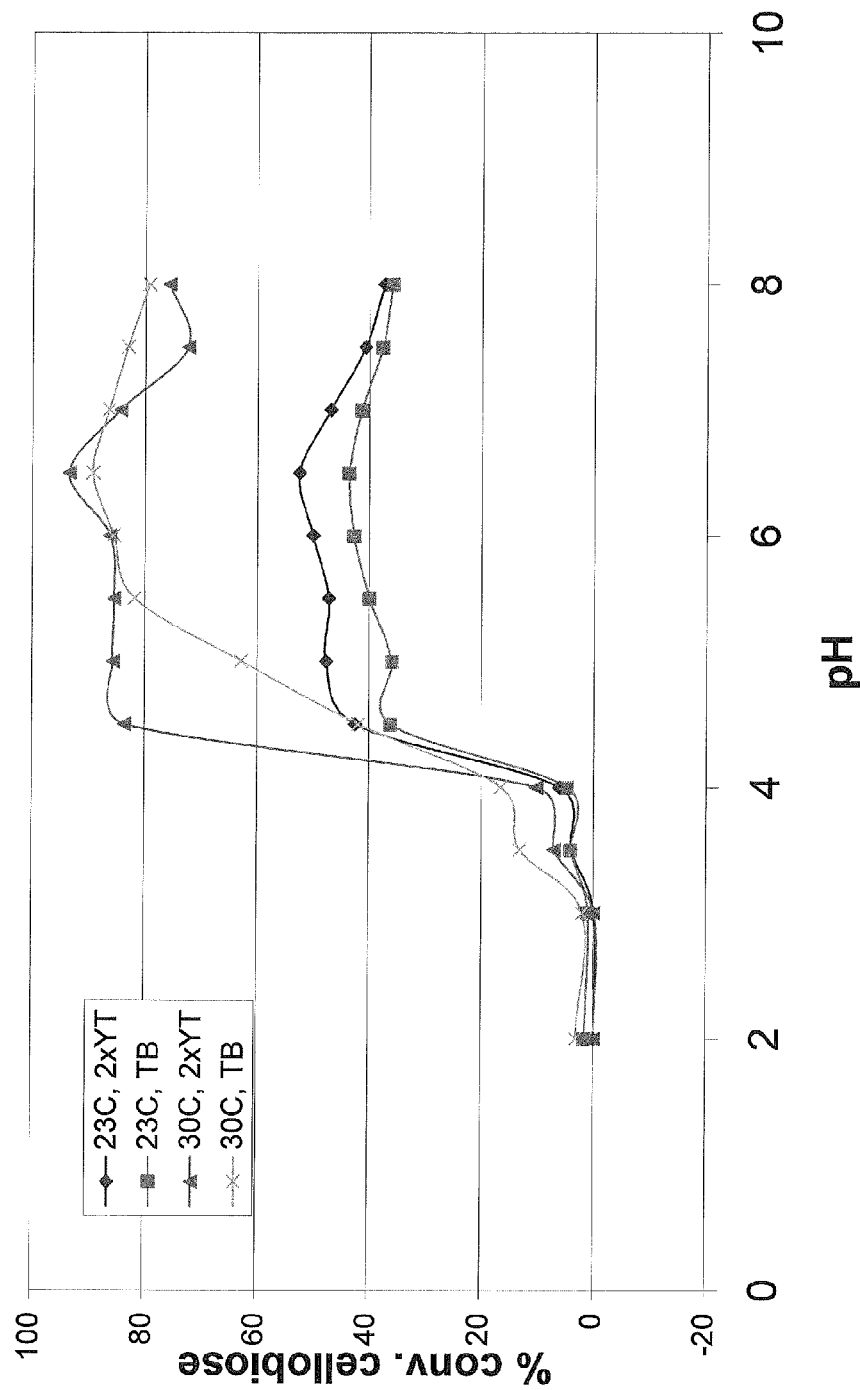
FIG. 3 is a plot of percent conversion of cellobiose vs. pH for the conversion of cellobiose to glucose by wild type *T. brockii* CglT (SEQ ID NO: 2). Activity is represented as the proportion of initial cellobiose converted to the product. The range of operable pH for the *E. coli*-produced enzyme was determined to be between pH 4.0 and 8.0.

FIG. 3 is a plot of percent conversion of cellobiose vs. pH for the conversion of cellobiose to glucose by *T. brockii* CglT. Experiments were conducted at 50° C. with 50 g/L of cellobiose for 20 minutes. 2XYT and TB indicates Yeast extract Tryptone, and Terrific Broth media, respectively at growth conditions of 23° C. and 30° C. Activity is represented as the proportion of initial cellobiose converted to the product. The range of operable pH for the *E. coli*-produced enzyme was found to be between 4-8.

Figure 4:
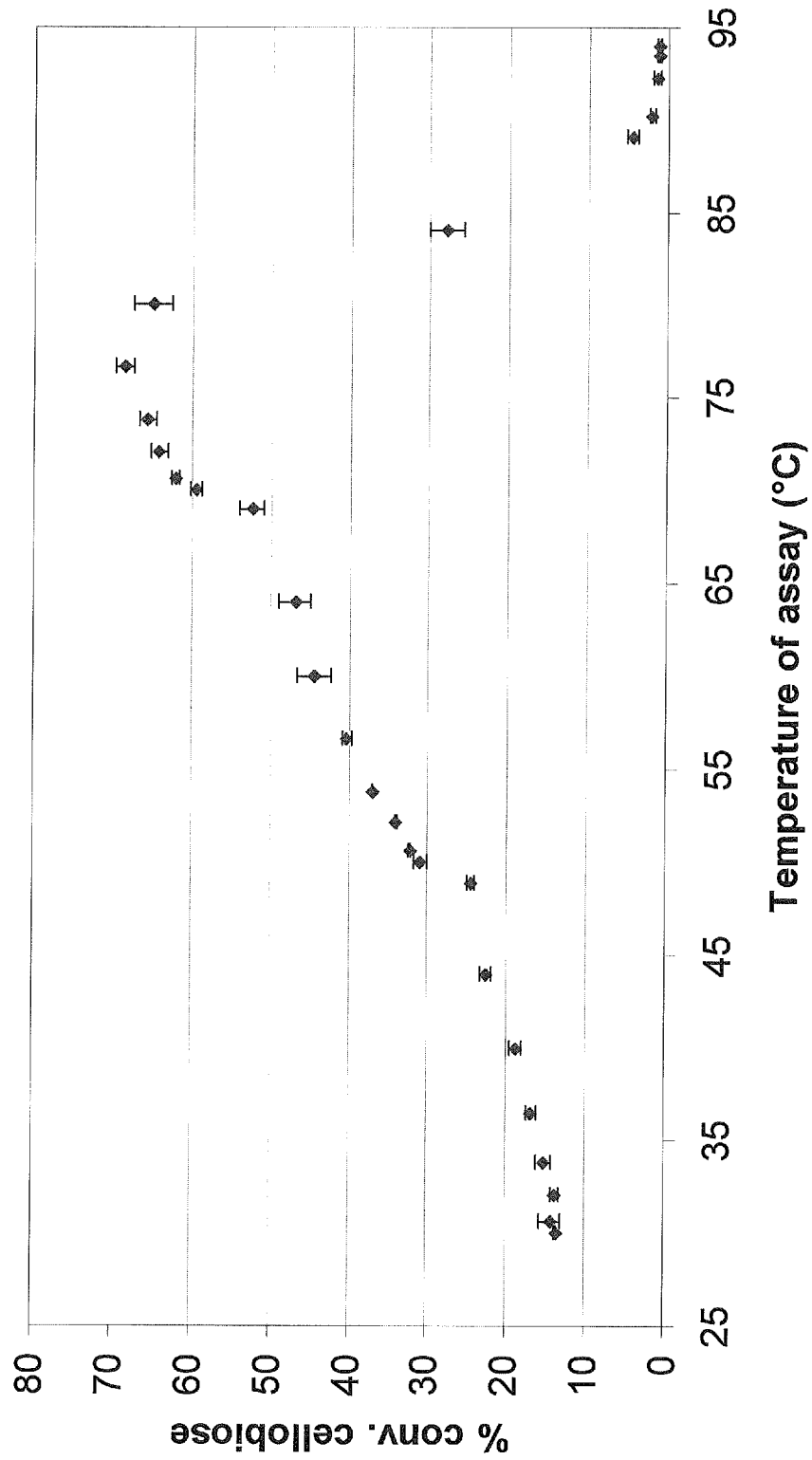
FIG. 4 is a plot of percent conversion of cellobiose vs. temperature of assay (° C.) for the conversion of cellobiose to glucose by wild type *T. brockii* CglT (SEQ ID NO: 2). Activity is represented as the proportion of initial cellobiose converted to the product. The optimal temperature of the *E. coli*-produced CglT was 75° C., and the range of operable temperature was determined to be between 50-80° C.

FIG. 4 is a plot of percent conversion of cellobiose vs. temperature of assay (° C.) for the conversion of cellobiose to glucose by *T. brockii* CglT, as prepared according to the methods of Examples 1 and 2. The optimal temperature of the *E. coli*-produced CglT in 2XYT media was 75° C. Experiments were conducted in pH 5 acetate buffer in the presence of 50 g/L cellobiose for 25 minutes. Activity is represented as the proportion of initial cellobiose converted to the product. The range of operable temperature for the CglT wild-type enzyme was determined to be between 50-80° C. The *E. coli*-produced enzyme from Example 2 was therefore active on cellobiose.

Example 4

High Throughput Assays to Identify Improved CglT Variants

Variants obtained from libraries of mutagenized CglT, were cloned and grown as described in Examples 1 and 2 with the following exceptions. The initial growth was done in 180 μA, and the expression was done in a 400 μl volume. Upon expression, cell pellets were lysed in 0.2 mg/mL PMBS (polymycin B sulfate; Gibco cat#21850-029), 0.25 mg/mL lysozyme (Sigma), 10 mM potassium phosphate buffer, pH 7, for 1 h while shaking at room temperature. These lysates were used to assay for enzyme activities.

The lysates were screened and evaluated for improvements over the wild-type *T. brockii* CGLT using both pNPG and cellobiose assays of Example 3. These assays were performed as described in Example 3 with the following exceptions. The pNPG reactions were carried out for 40 min at 50° C. in the presence of 100 g/L glucose, using 10 μA of 20-fold diluted lysate (diluted in 25 mM sodium acetate, pH 5, 0.25 mg/ml BSA). The cellobiose reactions were performed with 10 μA enzyme, at 50° C., with 3.3 g/L cellobiose. Glucose was added to the reaction at a final concentration of either 50 or 100 g/L. The reaction time for the cellobiose assay was optimized before screening using 25 mM sodium acetate, pH 5, to dilute enzyme. The dilution level typically was between 10-15 fold.

The pNPG assay was used as a first tier screen to eliminate dead variants from the screening process. Initially, the cellobiose assay was used to cross validate the discrimination of the live/dead variants by the pNPG assay as well as to identify improved variants. In the pNPG assay, all variants were assayed with and without the inhibitory product, 100 g/L of glucose. In parallel, the cellobiose assay was used to screen all variants without glucose in the reactions. Results from both screens indicated that the correlation between pNPG and cellobiose activity was relatively good with an $R^2$ of 0.74. For the remainder of the screening, all variants with pNPG activities of only 0.6 fold or above the positive control were re-evaluated with the cellobiose assay.

Example 5

Improved β-Glucosidase Activities of Engineered CglT Variants

Improved β-glucosidases derived from the wild-type CglT were evaluated using the HTP growth method, and the analytical methods described in Example 4. Table 2A and 2B depict certain β-glucosdidase polypeptide variants encompassed by the present invention, their SEQ ID NOs., and identification of the specific amino acid mutations from the wild-type enzyme (SEQ ID NO: 2), and their activities for converting cellobiose to glucose in the presence or absence of 50-100 g/L glucose (as fold improvements over either the wild type enzyme activity (SEQ ID NO: 2 in Table 2A) or a reference variant activity (SEQ ID NO: 4 in Table 2B), measured under similar conditions).

TABLE 2A

Improved β-glucosidase variants derived from the *T. brockii* CglT wild-type enzyme. These variants were directly compared to the wild-type ("WT") enzyme in screening.

| SEQ ID NO: | Variant Sequence (Mutations listed relative to SEQ ID NO: 2) | Silent mutations relative to SEQ ID NO: 1 | Fold improvement (−glucose) over wildtype SEQ ID NO: 2 |
|---|---|---|---|
| 2 | Wild-Type (Control) | | |
| 4 | K131I; I303V; D307A; I330V | t807c; c1296t | +++ |

TABLE 2A-continued

Improved β-glucosidase variants derived from the *T. brockii* CglT wild-type enzyme. These variants were directly compared to the wild-type ("WT") enzyme in screening.

| SEQ ID NO: | Variant Sequence (Mutations listed relative to SEQ ID NO: 2) | Silent mutations relative to SEQ ID NO: 1 | Fold improvement (−glucose) over wildtype SEQ ID NO: 2 |
|---|---|---|---|
| 6 | N27D; E64K; P84T; I159V; L239M | | ++ |
| 8 | A158V; I291N; F389I | t138c; t1125a | + |
| 10 | G134D; T427S | | ++ |
| 12 | L383H | a513g; a1089g; t1332c | + |
| 14 | A205V; H412W | | ++ |
| 16 | H412L | | + |
| 18 | H412V | | + |
| 20 | H412F | | + |
| 22 | I221V; H412V | | + |
| 24 | H412V | g540a | + |
| 26 | E64K; A231T | c678t | + |
| 28 | W328L | | ++ |

Wherein "+" indicates a fold improvement (FI) of 1.0 to 1.5; "++" indicates a FI of greater than 1.5 to 2.5 and "+++" indicates a FI of greater than 2.5.

Table 2B provides activity data corresponding to the improved β-glucosidase variants derived from the *T. brockii* CglT wild-type enzyme. These variants were not directly compared to the wild-type enzyme in screening but were compared to the best variant, from Table 2A (SEQ ID NO: 4) and this sequence was used as the control ("+control") in the determination of fold improvement (FI). The metric of fold improvement (FI) in the presence of 50 or 100 g/L glucose remained similar for all variants tested under both conditions.

| SEQ ID NO: | Variant sequence (Mutations listed relative to SEQ ID NO: 2) | Silent mutations relative to SEQ ID NO: 1 | FI (50 g/L glu) over SEQ ID NO: 4 | FI (100 g/L glu) over SEQ ID NO: 4 |
|---|---|---|---|---|
| 4 | K131I; I303V; D307A; I330V (control) | t807c; c1296t | | |
| 30 | N27D; E64K; P84T; Y129F I159V; L239M; I303V; D307A; Y352H; I330V; T427S; *451Q | | + | |
| 32 | P84T; Y129F; K131I; K150R; I159V; I303V; D307A; I330V; T427S; *451Q | a393t | +++ | +++ |
| 34 | N27D; P84T; Y129F; D307A; I330V; K397N; T427S; *451Q | a789g | ++ | ++ |
| 36 | P84T; K131I; L239M; T286A; I303V; D307A; I330V; T427S | t1128a | ++ | ++ |
| 38 | N27D; P84T; K131I; G134D; I159V; H202Y; L239M; I303V; D307A; I330V; *451Q | | +++ | +++ |
| 40 | N27D; Y47H; P84T; K131I; L239M; I303V; D307A; I330V; T427S | | ++ | ++ |
| 42 | K131I; K142E; I159V; L239M; I303V; I330V; T427S; *451Q | t339c | +++ | +++ |
| 44 | N27D; P84T; Y129F; I159V; L239M; D307A; I330V; T427S | | + | |
| 46 | S34G; P84T; Y129F; I303V; D307A; I330V; T427S; *451Q | t1179c | +++ | ++++ |
| 48 | N27D; E64K; P84T; Y129F; K131I; I303V; D307A; I330V; *451Q | a393t; a1269g | +++ | +++ |
| 50 | E64K; P84T; K131I; I159V; K215E; I330V; T427S; *451Q | | +++ | ++++ |
| 52 | N27D; P84T; K131I; L239M; D245G; I303V; D307A; W328L; I330V; K429N; *451Q | t990c | + | ++ |
| 54 | N27D; P84T; K131I; I159V; I330V | | +++ | +++ |

-continued

| SEQ ID NO: | Variant sequence (Mutations listed relative to SEQ ID NO: 2) | Silent mutations relative to SEQ ID NO: 1 | FI (50 g/L glu) over SEQ ID NO: 4 | FI (100 g/L glu) over SEQ ID NO: 4 |
|---|---|---|---|---|
| 56 | N27D; P84T; Y129F; G134D; I159V; A205G; L239M; I303V; D307A; I330V; T427S; *451Q | c228a; a285g | + | |
| 58 | P84T; Y129F; I159V; L239M; I330V | | ++ | ++ |
| 60 | N27D; E64K; P84T; K131I; I159V; D307A; I330V; T427S; *451Q | | +++ | ++++ |
| 62 | N27D; E64K; P84T; K131I; I303V; D307A; W328L; I330V; T427S; *451Q | t477a; t990c; t1302c | ++++ | ++++ |
| 64 | P84T; K131I; I159V; L239M; I303V; D307A; I330V; D445E; D446E | c387t; a393t | ++ | ++ |
| 66 | N27D; P84T; Y129F; I159V; I303V; D307A; I330V | | ++ | ++ |
| 68 | P84T; Y129F; K131I; I159V; H202Y; L239M; I256V; I303V; D307A; I330V; T427S; *451Q | a393t | ++ | |
| 70 | K131I; E153G; I303V; D307A; I330V; *451Q | t1062c | + | |
| 72 | N27D; E64K; I81V; K131I; I159V; L239M; I303V; D307A; I330V; M351L; T427S; *451Q | a444t; t744c | ++ | ++ |
| 74 | N27D; K131I; G134D; I159V; I303V; D307A; I330V; T427S; *451Q | c387t; a393t; t792c | + | + |
| 76 | N27D; E64K; P84T; K131I; I159V; L239M; I303V; D307A; I330V; T427S; *451Q | | +++ | +++ |
| 78 | N27D; P84T; K131I; G134D; I159V; L239M; I303V; I330V; T427S; *451Q | c387t; a393t | + | |
| 80 | P84T; K131I; I159V; L239M; I303V; D307A; I330V | | ++ | ++++ |
| 82 | E64K; P84T; K131I; I159V; H202Y; L239M; I303V; D307A; I330V; *451Q | c387t; a393t; t990c | ++ | |
| 84 | E64K; Y129F; K131I; I159V; L239M; I303V; I330V | a393t | + | |
| 86 | N27D; P84T; Y129F; K131I; G134D; I159V; T222A; L239M; I303V; I330V; T427S | a393t | ++ | |
| 88 | N27D; P84T; R111H; K131I; H202Y; I303V; T427S'\; *451Q | t255a; c387t; a393t; c588t | + | |
| 90 | N27D; K131I; I159V; L239M; D307A; I330V; T427S; *451Q | | +++ | + |
| 92 | P84T; Y129F; K131I; G134D; L239M; I303V; D307A; I330V; *451Q | a393t | ++ | |
| 94 | N27D; E64K; P84T; Y129F; K131I; G134D; I159V; F257S; I303V; T427S | a393t | ++ | |
| 96 | N27D; K131I; I159V; L239M; I303V; D307A; T427S | t537a | ++ | + |
| 98 | N27D; E64K; Y129F; K131I; G134D; I159V; L239M; D307A; I330V; T427S; *451Q | a393t; c912t | + | |
| 100 | N27D; K103E; Y129F; K131I; I159V; Y229H; L239M; I303V; D307A; I330V; T427S; *451Q | a393t | ++ | |
| 102 | N27D; E64K; P84T; K131I; I159V; L239M; I330V; T427S; *451Q | | + | |
| 104 | N27D; P84T; K131I; I303V; D307A; I330V; T427S; *451Q | | + | |
| 106 | N27D; E64K; P84T; Y129F; K131I; I159V; H202Y; A205G; D307A; *451Q | a393t | + | |
| 108 | N27D; Y129F; K131I; I159V; H202Y; L239M; I303V; D307A; I330V; T427S; *451Q | a393t; c588t; g765a; a939g; t1032c | + | |
| 110 | P84T; K131I; I159V; I303V; D307A; I330V; T427S; *451Q | | ++ | ++ |
| 112 | N27D; P84T; K131I; I159V; I303V; D307A; I330V; S334P; T427S; *451Q | | ++ | ++ |

-continued

| SEQ ID NO: | Variant sequence (Mutations listed relative to SEQ ID NO: 2) | Silent mutations relative to SEQ ID NO: 1 | FI (50 g/L glu) over SEQ ID NO: 4 | FI (100 g/L glu) over SEQ ID NO: 4 |
|---|---|---|---|---|
| 114 | N27D; P84T; G134D; I159V; H202Y; L239M; I303V; D307A; I330V; T427S; *451Q | c387t | + | |
| 116 | N27D; P84T; Y129F; I159V; L239M; I303V; D307A; W328L; *451Q | | + | |
| 118 | F11L; N27D; P84T; Y129F; I159V; A205G; L239M; A241T; I303V; D307A; I330V; T427S; V442A; *451P | t990c | ++ | ++ |
| 120 | N27D; P84T; K131I; G134D; D307A; I330V; *451Q | | +++ | +++ |
| 122 | N27D; P84T; I303V; I330V; T427S; *451Q | c387t | +++ | |
| 124 | K48N; A82P; K131I; A158V; E285G; I303V; I330V; H412V | c909t | ++ | |

Wherein "+" indicates a FI of greater than 0.1 to 1.0; "++" indicates a FI of greater than 1.0 to 2.0; "+++" indicates a FI of greater than 2.0 to 3.0 and "++++" indicates a FI of greater than 3.0.

While preferred embodiments of the invention have been illustrated and described, it will be readily appreciated that various changes can be made therein without departing from the spirit and scope of the invention.

SEQUENCE LISTING (124 sequences)

SEQ ID NO: 1 - DNA, 1356 bp, T. brockii
  CDS (1)..(1356)
atgattaaattagccaagtttccgcgtgattttgtgtggggaacggcgacatccagttatcaaatcgaaggggctgttaatgaagatggtcgtaccccgagtatctgggataccttctctaaaacggaggggaaaacttacaaaggtcatacaggtgatgtcgcatgtgaccattatcatcgctacaaagaggatgtcgagatcttaaaagaaattggagtaaaggcctaccgcttctcgattgcttggccacgtattttcccagaagaaggcaaatacaatccaaaaggcatggatttttacaagaagttgatcgatgaactccagaagcgcgatattgtccccgcggcgacgatttatcactgggatttaccgcagtgggcgtacgataaaggcggtggctggttaaatcgtgaaagcatcaaatggtatgtagaatatgcaaccaaactttttgaggaattgggtgacgccattcctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgtatcccgccagcgagaaagaagaagataagttggcggcgcagtacgccgacggctttgctaaccgttggttcctcgacccgatcttcaaaggaaactacccggaagatatgatggagttatatagcaagatcatcggcgagtttgattttatcaaagaaggcgacttggaaacgatctctgtcccaatcgactttttaggtgttaactattatacgcgctccatcgtcaaatacgatgaagactctatgcttaaagccgaaaacgtacctggtccgggcaaacgcaccgagatggggtgggaaatttcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatactacccagaaacgcatcctcaaagatagtgcgttgtggtacaaagaagtgattcttgatgacggcattgaagactaatga

SEQ ID NO: 2 - protein, 450 aa, T. brockii
MIKLAKFPRDFVWGTATSSYQIEGAVNEDGRTPSIWDTFSKTEGKTYKGHTGDVACDHYHRYKEDVEILKEIGVKAYRFSIAWPRIFPEEGKYNPKGMDFYKKLIDELQKRDIVPAATIYHWDLPQWAYDKGGGWLNRESIKWYVEYATKLFEELGDAIPLWITHNEPWCSSILSYGIGEHAPGHKNYREALIAAHHILLSHGEAVKAFREMNIKGSKIGITLNLTPAYPASEKEEDKLAAQYADGFANRWFLDPIFKGNYPEDMMELYSKIIGEFDFIKEGDLETISVPIDFLGVNYYTRSIVKYDEDSMLKAENVPGPGKRTEMGWEISPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTTQKRILKDSALWYKEVILDDGIED

SEQ ID NO: 3 - DNA, 1356 bp, Artificial Sequence
  CDS (1)..(1356): T. brockii beta-gluosidase variant
atgattaaattagccaagtttccgcgtgattttgtgtggggaacggcgacatccagttatcaaatcgaaggggctgttaatgaagatggtcgtaccccgagtatctgggataccttctctaaaacggaggggaaaacttacaaaggtcatacaggtgatgtcgcatgtgaccattatcatcgctacaaagaggatgtcgagatcttaaaagaaattggagtaaaggcctaccgcttctcgattgcttggccacgtattttcccagaagaaggcaaatacaatccaaaaggcatggatttttacaagaagttgatcgatgaactccagaagcgcgatattgtccccgcggcgacgatttatcactgggatttaccgcagtgggcgtacgatataggcggtggctggttaaatcgtgaaagcatcaaatggtatgtagaatatgcaaccaaactttttgaggaattgggtgacgccattcctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgtatcccgccagcgagaaagaagaagataagttggcggcgcagtacgccgacggctttgctaaccgttggttcctcgacccgatcttcaaaggaaactacccggaagatatgatggagttatacagcaagatcatcggcgagtttgattttatcaaagaaggcgacttggaaacgatctctgtcccaatcgactttttaggtgttaactattatacgcgctccgtcgtcaaatacgctgaagactctatgcttaaagccgaaaacgtacctggtccgggcaaacgcaccgagatggggtgggaagtttcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatactacccagaaacgcatccttaaagatagtgcgttgtggtacaaagaagtgattcttgatgacggcattgaagactaatga

SEQ ID NO: 4 - protein, 450 aa, Artificial Sequence
  T. brockii beta-glucosidase variant
MIKLAKFPRDFVWGTATSSYQIEGAVNEDGRTPSIWDTFSKTEGKTYKGHTGDVACDHYHRYKEDVEILKEIGVKAYRFSIAWPRIFPEEGKYNPKGMDFYKKLIDELQKRDIVPAATIYHWDLPQWAYDIGGGWLNRESIKWYVEYATKLFEELGDAIPLWITHNEPWCSSILSYGIGEHAPGHKNYREALIAAHHILLSHGEAVKAFREMNIKGSKIGITLNLTPAYPASEKEEDKLAAQYADGFANRWFLDPIFKGNYPEDMMELYSKIIGEFDFIKEGDLETISVPIDFLGVNYYTRSVVKYAEDSMLKAENVPGPGKRTEMGWEVSPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTTQKRILKDSALWYKEVILDDGIED

SEQ ID NO: 5 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttgatgaagatggtcgtaccccgagtatctgggataccttctctaaaacggaggggaaaacttacaaaggtcatacaggtgatgtcgcatgtgaccattatcatcgctacaaaaaggatgtcgagatcttaaaagaaattggagtaaaggcctaccgcttctcgattgcttggacacgtattttcccagaagaaggcaaatacaatccaaaaggcatggatttttacaagaagttgatcgatgaactccagaagcgcgatattgtccccgcggcgacgatttatcactgggatttaccgcagtgggcgtacgataaaggcggtggctggttaaatcgtgaaagcatcaaatggtatgtagaatatgcaaccaaactttttgaggaattgggtgacgccgttcctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgtatcccgccagcgagaaagaagaagataagatggcggcgcagtacgccgacggctttgctaaccgttggttcctcgacccgatcttcaaaggaaactacccggaagatatgatggagttatatagcaagatcatcggcgagtttgattttatcaaagaaggcgacttggaaacgatctctgtcccaatcgactttttaggtgttaactattatacgcgctccatcgtcaaatacgatgaagactctatgcttaaagccgaaaacgtacctggtccgggcaaacgcaccgagatggggtgggaaatttcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatactacccagaaacgcatcctcaaagatagtgcgttgtggtacaaagaagtgattcttgatgacggcattgaagactaatga

SEQ ID NO: 6 - protein, 450 aa, Artificial Sequence
  T. brockii beta-glucosidase variant
MIKLAKFPRDFVWGTATSSYQIEGAVDEDGRTPSIWDTFSKTEGKTYKGHTGDVACDHYHRYKKDVEILKEIGVKAYRFSIAWTRIFPEEGKYNPKGMDFYKKLIDELQKRDIVPAATIYHWDLPQWAYDKGGGWLNRESIKWYVEYATKLFEELGDAVPLWITHNEPWCSSILSYGIGEHAPGHKNYREALIAAHHILLSHGEAVKAFREMNIKGSKIGITLNLTPAYPASEKEEDKMAAQYADGFANRWFLDPIFKGNYPEDMMELYSKIIGEFDFIKEGDLETISVPIDFLGVNYYTRSIVKYDEDSMLKAENVPGPGKRTEMGWEISPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTTQKRILKDSALWYKEVILDDGIED

SEQ ID NO: 7 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttaatgaagatggtcgtaccccgagtatctgggataccttctctaaaacggaggggaaaacctacaaaggtcatacaggtgatgtcgcatgtgaccattatcatcgctacaaagaggatgtcgagatcttaaaagaaattggagtaaaggcctaccgcttctcgattgcttggccacgtattttcccagaagaaggcaaatacaatccaaaaggcatggatttttacaagaagttgatcgatgaactccagaagcgcgatattgtccccgcggcgacgatttatcactgggatttaccgcagtgggcgtacgataaaggcggtggctggttaaatcgtgaaagcatcaaatggtatgtagaatatgcaaccaaactttttgaggaattgggtgacgtcattcctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgtatcccgccagcgagaaagaagaagataagttggcggcgcagtacgccgacggctttgctaaccgttggttcctcgacccgatcttcaaaggaaactacccggaagatatgatggagttatatagcaagatcatcggcgagtttgattttatcaaagaaggcgacttggaaacgatctctgtcccaaacgactttttaggtgttaactattatacgcgctccatcgtcaaatacgatgaagactctatgcttaaagccgaaaacgtacctggtccgggcaaacgcaccgagatggggtgggaaatttcgccggagtcattatatgaccttcttaagcggctcgaccgtgagtataccaaattacctatgtacattactgaaaacggcgctgcattcaaagacgaagttactgaagatgggcgcgttcacgatgatgagcgaattgaatacatcaaagagcaccttaaggcggccgctaaaatcattggagaaggtggcaaccttaaaggttacttcgtgtggtcattgatggataattttgaatgggcacacgggtattccaaacgttttggcattgtttatgtagattatactacccagaaacgcatcctcaaagatagtgcgttgtggtacaaagaagtgattcttgatgacggcattgaagactaatga

SEQ ID NO: 8 - protein, 450 aa, Artificial Sequence
  T. brockii beta-glucosidase variant
MIKLAKFPRDFVWGTATSSYQIEGAVNEDGRTPSIWDTFSKTEGKTYKGHTGDVACDHYHRYKEDVEILKEIGVKAYRFSIAWPRIFPEEGKYNPKGMDFYKKLIDELQKRDIVPAATIYHWDLPQWAYDKGGGWLNRESIKWYVEYATKLFEELGDVIPLWITHNEPWCSSILSYGIGEHAPGHKNYREALIAAHHILLSHGEAVKAFREMNIKGSKIGITLNLTPAYPASEKEEDKLAAQYADGFANRWFLDPIFKGNYPEDMMELYSKIIGEFDFIKEGDLETISVPNDFLGVNYYTRSIVKYDEDSMLKAENVPGPGKRTEMGWEISPESLYDLLKRLDREYTKLPMYITENGAAFKDEVTEDGRVHDDERIEYIKEHLKAAAKIIGEGGNLKGYFVWSLMDNFEWAHGYSKRFGIVYVDYTTQKRILKDSALWYKEVILDDGIED

SEQ ID NO: 9 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttaatgaagatggtcgtaccccgagtatctgggataccttctctaaaacggaggggaaaacttacaaaggtcatacaggtgatgtcgcatgtgaccattatcatcgctacaaagaggatgtcgagatcttaaaagaaattggagtaaaggcctaccgcttctcgattgcttggccacgtattttcccagaagaaggcaaatacaatccaaaaggcatggatttttacaagaagttgatcgatgaactccagaagcgcgatattgtccccgcggcgacgatttatcactgggatttaccgcagtgggcgtacgataaaggcggtgactggttaaatcgtgaaagcatcaaatggtatgtagaatatgcaaccaaactttttgaggaattgggtgacgccattcctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgtatcccgccagcgagaaagaagaagataagttggcggcgcagtacgccgacggctttgctaaccgttggttcctcgacccgatcttcaaaggaaactacccggaagatatgatggagttatatagcaagatcatcggcgagtttgattttatcaaagaaggcgacttggaaacgatctctgtcccaatcgactttttaggtgttaactattatacgcgctccatcgtcaaatacgatgaagactctatgcttaaagccgaaaacgtacctggtccgggcaaacgcaccgagatggggtgggaaatttcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatactagccagaaacgcatcctcaaagatagtgcgttgtggtacaaagaagtgattcttgatgacggcattgaagactaatga

SEQ ID NO: 10 - protein, 450 aa, Artificial Sequence
  T. brockii beta-glucosidase variant
MIKLAKFPRDFVWGTATSSYQIEGAVNEDGRTPSIWDTFSKTEGKTYKGHTGDVACDHYHRYKEDVEILKEIGVKAYRFSIAWPRIFPEEGKYNPKGMDFYKKLIDELQKRDIVPAATIYHWDLPQWAYDKGGDWLNRESIKWYVEYATKLFEELGDAIPLWITHNEPWCSSILSYGIGEHAPGHKNYREALIAAHHILLSHGEAVKAFREMNIKGSKIGITLNLTPAYPASEKEEDKLAAQYADGFANRWFLDPIFKGNYPEDMMELYSKIIGEFDFIKEGDLETISVPIDFLGVNYYTRSIVKYDEDSMLKAENVPGPGKRTEMGWEISPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTSQKRILKDSALWYKEVILDDGIED

SEQ ID NO: 11 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttaatgaagatggtcgtaccccgagtatctgggataccttctctaaaacggaggggaaaacttacaaaggtcatacaggtgatgtcgcatgtgaccattatcatcgctacaaagaggatgtcgagatcttaaaagaaattggagtaaaggcctaccgcttctcgattgcttggccacgtattttcccagaagaaggcaaatacaatccaaaaggcatggatttttacaagaagttgatcgatgaactccagaagcgcgatattgtccccgcggcgacgatttatcactgggatttaccgcagtgggcgtacgataaaggcggtggctggttaaatcgtgaaagcatcaaatggtatgtagaatatgcaaccaaactttttgaggaattgggtgacgccattcctctctggatcacacataatgaaccgtggtgttcgagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgtatcccgccagcgagaaagaagaagataagttggcggcgcagtacgccgacggctttgctaaccgttggttcctcgacccgatcttcaaaggaaactacccggaagatatgatggagttatatagcaagatcatcggcgagtttgattttatcaaagaaggcgacttggaaacgatctctgtcccaatcgactttttaggtgttaactattatacgcgctccatcgtcaaatacgatgaagactctatgcttaaagccgaaaacgtacctggtccgggcaaacgcaccgagatggggtgggaaatttcgccggagtcattatatgaccttcttaagcggctcgaccgtgagtataccaaattacctatgtacattactgaaaacggcgctgcattcaaagacgaggttactgaagatgggcgcgttcacgatgatgagcgtattgaatacatcaaagagcaccataaggcggccgctaaattcattggagaaggtggcaaccttaaaggttacttcgtgtggtcattgatggataattttgaatgggcacacgggtattccaaacgttttggcattgtttatgtagattatactacccagaaacgcatcctcaaagatagtgcgttgtggtacaaagaagtgattctcgatgacggcattgaagactaatga

SEQ ID NO: 12 - protein, 450 aa, Artificial Sequence
  T. brockii beta-glucosidase variant
MIKLAKFPRDFVWGTATSSYQIEGAVNEDGRTPSIWDTFSKTEGKTYKGHTGDVACDHYHRYKEDVEILKEIGVKAYRFSIAWPRIFPEEGKYNPKGMDFYKKLIDELQKRDIVPAATIYHWDLPQWAYDKGGGWLNRESIKWYVEYATKLFEELGDAIPLWITHNEPWCSSILSYGIGEHAPGHKNYREALIAAHHILLSHGEAVKAFREMNIKGSKIGITLNLTPAYPASEKEEDKLAAQYADGFANRWFLDPIFKGNYPEDMMELYSKIIGEFDFIKEGDLETISVPIDFLGVNYYTRSIVKYDEDSMLKAENVPGPGKRTEMGWEISPESLYDLLKRLDREYTKLPMYITENGAAFKDEVTEDGRVHDDERIEYIKEHHKAAAKFIGEGGNLKGYFVWSLMDNFEWAHGYSKRFGIVYVDYTTQKRILKDSALWYKEVILDDGIED

SEQ ID NO: 13 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttaatgaagatggtcgtaccccgagtatctgggataccttctctaaaacggaggggaaaacttacaaaggtcatacaggtgatgtcgcatgtgaccattatcatcgctacaaagaggatgtcgagatcttaaaagaaattggagtaaaggcctaccgcttctcgattgcttggccacgtattttcccagaagaaggcaaatacaatccaaaaggcatggatttttacaagaagttgatcgatgaactccagaagcgcgatattgtccccgcggcgacgatttatcactgggatttaccgcagtgggcgtacgataaaggcggtggctggttaaatcgtgaaagcatcaaatggtatgtagaatatgcaaccaaactttttgaggaattgggtgacgccattcctctctggatcacacataatgaaccgtggtgttcaagtattttgagctatggtattggtgagcatgcgcctggccataaaaactatcgcgaagcactcattgctgcacaccatattttgttgtcgcacggtgaagtcgtgaaagcattccgggagatgaatatcaaagggtccaagattggaatcaccctcaatctcaccccagcgtatcccgccagcgagaaagaagaagataagttggcggcgcagtacgccgacggctttgctaaccgttggttcctcgacccgatcttcaaaggaaactacccggaagatatgatggagttatatagcaagatcatcggcgagtttgattttatcaaagaaggcgacttggaaacgatctctgtcccaatcgactttttaggtgttaactattatacgcgctccatcgtcaaatacgatgaagactctatgcttaaagccgaaaacgtacctggtccgggcaaacgcaccgagatggggtgggaaatttcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcatgggggtattccaaacgttttggcattgtttatgtagattatactacccagaaacgcatcctcaaagatagtgcgttgtggtacaaagaagtgattcttgatgacggcattgaagactaatga

SEQ ID NO: 14 - protein, 450 aa, Artificial Sequence
  T. brockii beta-glucosidase variant
MIKLAKFPRDFVWGTATSSYQIEGAVNEDGRTPSIWDTFSKTEGKTYKGHTGDVACDHYHRYKEDVEILKEIGVKAYRFSIAWPRIFPEEGKYNPKGMDFYKKLIDELQKRDIVPAATIYHWDLPQWAYDKGGGWLNRESIKWYVEYATKLFEELGDAIPLWITHNEPWCSSILSYGIGEHAPGHKNYREALIAAHHILLSHGEVVKAFREMNIKGSKIGITLNLTPAYPASEKEEDKLAAQYADGFANRWFLDPIFKGNYPEDMMELYSKIIGEFDFIKEGDLETISVPIDFLGVNYYTRSIVKYDEDSMLKAENVPGPGKRTEMGWEISPESLYDLLKRLDREYTKLPMYITENGAAFKDEVTEDGRVHDDERIEYIKEHLKAAAKFIGEGGNLKGYFVWSLMDNFEWAWGYSKRFGIVYVDYTTQKRILKDSALWYKEVILDDGIED

SEQ ID NO: 15 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttaatgaagatggtcgtaccccgagtatctgggataccttctctaaaacggaggggaaaacttacaaaggtcatacaggtgatgtcgcatgtgaccattatcatcgctacaaagaggatgtcgagatcttaaaagaaattggagtaaaggcctaccgcttctcgattgcttggccacgtattttcccagaagaaggcaaatacaatccaaaaggcatggatttttacaagaagttgatcgatgaactccagaagcgcgatattgtccccgcggcgacgatttatcactgggatttaccgcagtgggcgtacgataaaggcggtggctggttaaatcgtgaaagcatcaaatggtatgtagaatatgcaaccaaactttttgaggaattgggtgacgccattcctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgtatcccgccagcgagaaagaagaagataagttggcggcgcagtacgccgacggctttgctaaccgttggttcctcgacccgatcttcaaaggaaactacccggaagatatgatggagttatatagcaagatcatcggcgagtttgattttatcaaagaaggcgacttggaaacgatctctgtcccaatcgactttttaggtgttaactattatacgcgctccatcgtcaaatacgatgaagactctatgcttaaagccgaaaacgtacctggtccgggcaaacgcaccgagatggggtgggaaatttcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcattggggtattccaaacgttttggcattgtttatgtagattatactacccagaaacgcatcctcaaagatagtgcgttgtggtacaaagaagtgattcttgatgacggcattgaagactaatga

SEQ ID NO: 16 - protein, 450 aa, Artificial Sequence
  T. brockii beta-glucosidase variant
MIKLAKFPRDFVWGTATSSYQIEGAVNEDGRTPSIWDTFSKTEGKTYKGHTGDVACDHYHRYKEDVEILKEIGVKAYRFSIAWPRIFPEEGKYNPKGMDFYKKLIDELQKRDIVPAATIYHWDLPQWAYDKGGGWLNRESIKWYVEYATKLFEELGDAIPLWITHNEPWCSSILSYGIGEHAPGHKNYREALIAAHHILLSHGEAVKAFREMNIKGSKIGITLNLTPAYPASEKEEDKLAAQYADGFANRWFLDPIFKGNYPEDMMELYSKIIGEFDFIKEGDLETISVPIDFLGVNYYTRSIVKYDEDSMLKAENVPGPGKRTEMGWEISPESLYDLLKRLDREYTKLPMYITENGAAFKDEVTEDGRVHDDERIEYIKEHLKAAAKFIGEGGNLKGYFVWSLMDNFEWALGYSKRFGIVYVDYTTQKRILKDSALWYKEVILDDGIED

SEQ ID NO: 17 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttaatgaagatggtcgtaccccgagtatctgggataccttctctaaaacggaggggaaaacttacaaaggtcatacaggtgatgtcgcatgtgaccattatcatcgctacaaagaggatgtcgagatcttaaaagaaattggagtaaaggcctaccgcttctcgattgcttggccacgtattttcccagaagaaggcaaatacaatccaaaaggcatggatttttacaagaagttgatcgatgaactccagaagcgcgatattgtccccgcggcgacgatttatcactgggatttaccgcagtgggcgtacgataaaggcggtggctggttaaatcgtgaaagcatcaaatggtatgtagaatatgcaaccaaactttttgaggaattgggtgacgccattcctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgtatcccgccagcgagaaagaagaagataagttggcggcgcagtacgccgacggctttgctaaccgttggttcctcgacccgatcttcaaaggaaactacccggaagatatgatggagttatatagcaagatcatcggcgagtttgattttatcaaagaaggcgacttggaaacgatctctgtcccaatcgactttttaggtgttaactattatacgcgctccatcgtcaaatacgatgaagactctatgcttaaagccgaaaacgtacctggtccgggcaaacgcaccgagatggggtgggaaatttcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcagtggggtattccaaacgttttggcattgtttatgtagattatactacccagaaacgcatcctcaaagatagtgcgttgtggtacaaagaagtgattcttgatgacggcattgaagactaatga

SEQ ID NO: 18 - protein, 450 aa, Artificial Sequence
  T. brockii beta-glucosidase variant
MIKLAKFPRDFVWGTATSSYQIEGAVNEDGRTPSIWDTFSKTEGKTYKGHTGDVACDHYHRYKEDVEILKEIGVKAYRFSIAWPRIFPEEGKYNPKGMDFYKKLIDELQKRDIVPAATIYHWDLPQWAYDKGGGWLNRESIKWYVEYATKLFEELGDAIPLWITHNEPWCSSILSYGIGEHAPGHKNYREALIAAHHILLSHGEAVKAFREMNIKGSKIGITLNLTPAYPASEKEEDKLAAQYADGFANRWFLDPIFKGNYPEDMMELYSKIIGEFDFIKEGDLETISVPIDFLGVNYYTRSIVKYDEDSMLKAENVPGPGKRTEMGWEISPESLYDLLKRLDREYTKLPMYITENGAAFKDEVTEDGRVHDDERIEYIKEHLKAAAKFIGEGGNLKGYFVWSLMDNFEWAVGYSKRFGIVYVDYTTQKRILKDSALWYKEVILDDGIED

SEQ ID NO: 19 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttaatgaagatggtcgtaccccgagtatctgggataccttctctaaaacggaggggaaaacttacaaaggtcatacaggtgatgtcgcatgtgaccattatcatcgctacaaagaggatgtcgagatcttaaaagaaattggagtaaaggcctaccgcttctcgattgcttggccacgtattttcccagaagaaggcaaatacaatccaaaaggcatggatttttacaagaagttgatcgatgaactccagaagcgcgatattgtccccgcggcgacgatttatcactgggatttaccgcagtgggcgtacgataaaggcggtggctggttaaatcgtgaaagcatcaaatggtatgtagaatatgcaaccaaactttttgaggaattgggtgacgccattcctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgtatcccgccagcgagaaagaagaagataagttggcggcgcagtacgccgacggctttgctaaccgttggttcctcgacccgatcttcaaaggaaactacccggaagatatgatggagttatatagcaagatcatcggcgagtttgattttatcaaagaaggcgacttggaaacgatctctgtcccaatcgactttttaggtgttaactattatacgcgctccatcgtcaaatacgatgaagactctatgcttaaagccgaaaacgtacctggtccgggcaaacgcaccgagatggggtgggaaatttcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcatttgggtattccaaacgttttggcattgtttatgtagattatactacccagaaacgcatcctcaaagatagtgcgttgtggtacaaagaagtgattcttgatgacggcattgaagactaatga

SEQ ID NO: 20 - protein, 450 aa, Artificial Sequence
  T. brockii beta-glucosidase variant
MIKLAKFPRDFVWGTATSSYQIEGAVNEDGRTPSIWDTFSKTEGKTYKGHTGDVACDHYHRYKEDVEILKEIGVKAYRFSIAWPRIFPEEGKYNPKGMDFYKKLIDELQKRDIVPAATIYHWDLPQWAYDKGGGWLNRESIKWYVEYATKLFEELGDAIPLWITHNEPWCSSILSYGIGEHAPGHKNYREALIAAHHILLSHGEAVKAFREMNIKGSKIGITLNLTPAYPASEKEEDKLAAQYADGFANRWFLDPIFKGNYPEDMMELYSKIIGEFDFIKEGDLETISVPIDFLGVNYYTRSIVKYDEDSMLKAENVPGPGKRTEMGWEISPESLYDLLKRLDREYTKLPMYITENGAAFKDEVTEDGRVHDDERIEYIKEHLKAAAKFIGEGGNLKGYFVWSLMDNFEWAFGYSKRFGIVYVDYTTQKRILKDSALWYKEVILDDGIED

SEQ ID NO: 21 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttaatgaagatggtcgtaccccgagtatctgggataccttctctaaaacggaggggaaaacttacaaaggtcatacaggtgatgtcgcatgtgaccattatcatcgctacaaagaggatgtcgagatcttaaaagaaattggagtaaaggcctaccgcttctcgattgcttggccacgtattttcccagaagaaggcaaatacaatccaaaaggcatggatttttacaagaagttgatcgatgaactccagaagcgcgatattgtccccgcggcgacgatttatcactgggatttaccgcagtgggcgtacgataaaggcggtggctggttaaatcgtgaaagcatcaaatggtatgtagaatatgcaaccaaactttttgaggaattgggtgacgccattcctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggagtcaccctcaatctcaccccagcgtatcccgccagcgagaaagaagaagataagttggcggcgcagtacgccgacggctttgctaaccgttggttcctcgacccgatcttcaaaggaaactacccggaagatatgatggagttatatagcaagatcatcggcgagtttgattttatcaaagaaggcgacttggaaacgatctctgtcccaatcgactttttaggtgttaactattatacgcgctccatcgtcaaatacgatgaagactctatgcttaaagccgaaaacgtacctggtccgggcaaacgcaccgagatggggtgggaaatttcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcagttgggtattccaaacgttttggcattgtttatgtagattatactacccagaaacgcatcctcaaagatagtgcgttgtggtacaaagaagtgattcttgatgacggcattgaagactaatga

SEQ ID NO: 22 - protein, 450 aa, Artificial Sequence
  T. brockii beta-glucosidase variant
MIKLAKFPRDFVWGTATSSYQIEGAVNEDGRTPSIWDTFSKTEGKTYKGHTGDVACDHYHRYKEDVEILKEIGVKAYRFSIAWPRIFPEEGKYNPKGMDFYKKLIDELQKRDIVPAATIYHWDLPQWAYDKGGGWLNRESIKWYVEYATKLFEELGDAIPLWITHNEPWCSSILSYGIGEHAPGHKNYREALIAAHHILLSHGEAVKAFREMNIKGSKIGVTLNLTPAYPASEKEEDKLAAQYADGFANRWFLDPIFKGNYPEDMMELYSKIIGEFDFIKEGDLETISVPIDFLGVNYYTRSIVKYDEDSMLKAENVPGPGKRTEMGWEISPESLYDLLKRLDREYTKLPMYITENGAAFKDEVTEDGRVHDDERIEYIKEHLKAAAKFIGEGGNLKGYFVWSLMDNFEWAVGYSKRFGIVYVDYTTQKRILKDSALWYKEVILDDGIED

SEQ ID NO: 23 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttaatgaagatggtcgtaccccgagtatctgggataccttctctaaaacggaggggaaaacttacaaaggtcatacaggtgatgtcgcatgtgaccattatcatcgctacaaagaggatgtcgagatcttaaaagaaattggagtaaaggcctaccgcttctcgattgcttggccacgtattttcccagaagaaggcaaatacaatccaaaaggcatggatttttacaagaagttgatcgatgaactccagaagcgcgatattgtccccgcggcgacgatttatcactgggatttaccgcagtgggcgtacgataaaggcggtggctggttaaatcgtgaaagcatcaaatggtatgtagaatatgcaaccaaactttttgaggaattgggtgacgccattcctctctggatcacacataatgaaccgtggtgttcaagtattttgagctatggtattggtgaacatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgtatcccgccagcgagaaagaagaagataagttggcggcgcagtacgccgacggctttgctaaccgttggttcctcgacccgatcttcaaaggaaactacccggaagatatgatggagttatatagcaagatcatcggcgagtttgattttatcaaagaaggcgacttggaaacgatctctgtcccaatcgactttttaggtgttaactattatacgcgctccatcgtcaaatacgatgaagactctatgcttaaagccgaaaacgtacctggtccgggcaaacgcaccgagatggggtgggaaatttcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcagttgggtattccaaacgttttggcattgtttatgtagattatactacccagaaacgcatcctcaaagatagtgcgttgtggtacaaagaagtgattcttgatgacggcattgaagactaatga

SEQ ID NO: 24 - protein, 450 aa, Artificial Sequence; identical to SEQ ID NO: 18
  T. brockii beta-glucosidase variant

SEQ ID NO: 25 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttaatgaagatggtcgtaccccgagtatctgggataccttctctaaaacggaggggaaaacttacaaaggtcatacaggtgatgtcgcatgtgaccattatcatcgctacaaagtggatgtcgagatcttaaaagaaattggagtaaaggcctaccgcttctcgattgcttggccacgtattttcccagaagaaggcaaatacaatccaaaaggcatggatttttacaagaagttgatcgatgaactccagaagcgcgatattgtccccgcggcgacgatttatcactgggatttaccgcagtgggcgtacgataaaggcggtggctggttaaatcgtgaaagcatcaaatggtatgtagaatatgcaaccaaactttttgaggaattgggtgacgccattcctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcaccctcaatctcactccagcgtatcccaccagcgagaaagaagaagataagttggcggcgcagtacgccgacggctttgctaaccgttggttcctcgacccgatcttcaaaggaaactacccggaagatatgatggagttatatagcaagatcatcggcgagtttgattttatcaaagaaggcgacttggaaacgatctctgtcccaatcgactttttaggtgttaactattatacgcgctccatcgtcaaatacgatgaagactctatgcttaaagccgaaaacgtacctggtccgggcaaacgcaccgagatggggtgggaaatttcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatactacccagaaacgcatcctcaaagatagtgcgttgtggtacaaagaagtgattcttgatgacggcattgaagactaatga

SEQ ID NO: 26 - protein, 450 aa, Artificial Sequence
  T. brockii beta-glucosidase variant
MIKLAKFPRDFVWGTATSSYQIEGAVNEDGRTPSIWDTFSKTEGKTYKGHTGDVACDHYHRYKVDVEILKEIGVKAYRFSIAWPRIFPEEGKYNPKGMDFYKKLIDELQKRDIVPAATIYHWDLPQWAYDKGGGWLNRESIKWYVEYATKLFEELGDAIPLWITHNEPWCSSILSYGIGEHAPGHKNYREALIAAHHILLSHGEAVKAFREMNIKGSKIGITLNLTPAYPTSEKEEDKLAAQYADGFANRWFLDPIFKGNYPEDMMELYSKIIGEFDFIKEGDLETISVPIDFLGVNYYTRSIVKYDEDSMLKAENVPGPGKRTEMGWEISPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTTQKRILKDSALWYKEVILDDGIED

SEQ ID NO: 27 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttaatgaagatggtcgtaccccgagtatctgggataccttctctaaaacggaggggaaaacttacaaaggtcatacaggtgatgtcgcatgtgaccattatcatcgctacaaagaggatgtcgagatcttaaaagaaattggagtaaaggcctaccgcttctcgattgcttggccacgtattttcccagaagaaggcaaatacaatccaaaaggcatggatttttacaagaagttgatcgatgaactccagaagcgcgatattgtccccgcggcgacgatttatcactgggatttaccgcagtgggcgtacgataaaggcggtggctggttaaatcgtgaaagcatcaaatggtatgtagaatatgcaaccaaactttttgaggaattgggtgacgccattcctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgtatcccgccagcgagaaagaagaagataagttggcggcgcagtacgccgacggctttgctaaccgttggttcctcgacccgatcttcaaaggaaactacccggaagatatgatggagttatatagcaagatcatcggcgagtttgattttatcaaagaaggcgacttggaaacgatctctgtcccaatcgactttttaggtgttaactattatacgcgctccatcgtcaaatacgatgaagactctatgcttaaagccgaaaacgtacctggtccgggcaaacgcaccgagatggggttggaaatttcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatactacccagaaacgcatcctcaaagatagtgcgttgtggtacaaagaagtgattcttgatgacggcattgaagactaatga

SEQ ID NO: 28 - protein, 450 aa, Artificial Sequence
  T. brockii beta-glucosidase variant
MIKLAKFPRDFVWGTATSSYQIEGAVNEDGRTPSIWDTFSKTEGKTYKGHTGDVACDHYHRYKEDVEILKEIGVKAYRFSIAWPRIFPEEGKYNPKGMDFYKKLIDELQKRDIVPAATIYHWDLPQWAYDKGGGWLNRESIKWYVEYATKLFEELGDAIPLWITHNEPWCSSILSYGIGEHAPGHKNYREALIAAHHILLSHGEAVKAFREMNIKGSKIGITLNLTPAYPASEKEEDKLAAQYADGFANRWFLDPIFKGNYPEDMMELYSKIIGEFDFIKEGDLETISVPIDFLGVNYYTRSIVKYDEDSMLKAENVPGPGKRTEMGLEISPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTTQKRILKDSALWYKEVILDDGIED

SEQ ID NO: 29 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttgacgaagatggtcgtaccccgagtatctgggataccttctctaaaacggaggggaaaacttacaaaggtcatacaggtgatgtcgcatgtgaccattatcatcgctacaaaaaggatgtcgagatcttaaaagaaattggagtaaaggcctaccgcttctcgattgcttggacgcgtattttcccagaagaaggcaaatacaatccaaaaggcatggatttttacaagaagttgatcgatgaactccagaagcgcgatattgtccccgcggcgacgatttatcactgggatttaccgcagtgggcgtttgataaaggcggtggctggttaaatcgtgaaagcatcaaatggtatgtagaatatgcaaccaaactttttgaggaattgggtgacgccgtacctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgtatcccgccagcgagaaagaagaagataagatggcggcgcagtacgccgacggctttgctaaccgttggttcctcgacccgatcttcaaaggaaactacccggaagatatgatggagttatacagcaagatcatcggcgagtttgattttatcaaagaaggcgacttggaaacgatctctgtcccaatcgactttttaggtgttaactattatacgcgctccgtcgtcaaatacgctgaagactctatgcttaaagccgaaaacgtacctggtccgggcaaacgcaccgagatggggtgggaagtttcgccggagtcattatatgaccttcttaagcggctcgaccgtgagtataccaaattacctatgcacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatacttcgcagaaacgcatccttaaagatagtgcgttgtggtacaaagaagtgattcttgatgacggcattgaagaccagtga

SEQ ID NO: 30 - protein, 451 aa, Artificial Sequence
  T. brockii beta-glucosidase variant
MIKLAKFPRDFVWGTATSSYQIEGAVDEDGRTPSIWDTFSKTEGKTYKGHTGDVACDHYHRYKKDVEILKEIGVKAYRFSIAWTRIFPEEGKYNPKGMDFYKKLIDELQKRDIVPAATIYHWDLPQWAFDKGGGWLNRESIKWYVEYATKLFEELGDAVPLWITHNEPWCSSILSYGIGEHAPGHKNYREALIAAHHILLSHGEAVKAFREMNIKGSKIGITLNLTPAYPASEKEEDKMAAQYADGFANRWFLDPIFKGNYPEDMMELYSKIIGEFDFIKEGDLETISVPIDFLGVNYYTRSVVKYAEDSMLKAENVPGPGKRTEMGWEVSPESLYDLLKRLDREYTKLPMHITENGAAFKDEVTEDGRVHDDERIEYIKEHLKAAAKFIGEGGNLKGYFVWSLMDNFEWAHGYSKRFGIVYVDYTSQKRILKDSALWYKEVILDDGIEDQ

SEQ ID NO: 31 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttaatgaagatggtcgtaccccgagtatctgggataccttctctaaaacggaggggaaaacttacaaaggtcatacaggtgatgtcgcatgtgaccattatcatcgctacaaagaggatgtcgagatcttaaaagaaattggagtaaaggcctaccgcttctcgattgcttggacgcgtattttcccagaagaaggcaaatacaatccaaaaggcatggatttttacaagaagttgatcgatgaactccagaagcgcgatattgtccccgcggcgacgatttatcactgggatttaccgcagtgggcgtttgatattggcggtggctggttaaatcgtgaaagcatcaaatggtatgtagaatatgcaaccagactttttgaggaattgggtgacgccgtacctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgtatcccgccagcgagaaagaagaagataagttggcggcgcagtacgccgacggctttgctaaccgttggttcctcgacccgatcttcaaaggaaactacccggaagatatgatggagttatacagcaagatcatcggcgagtttgattttatcaaagaaggcgacttggaaacgatctctgtcccaatcgactttttaggtgttaactattatacgcgctccgtcgtcaaatacgctgaagactctatgcttaaagccgaaaacgtacctggtccgggcaaacgcaccgagatggggtgggaagtttcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatacttcgcagaaacgcatccttaaagatagtgcgttgtggtacaaagaagtgattcttgatgacggcattgaagaccagtga

SEQ ID NO: 32 - protein, 451 aa, Artificial Sequence
  T. brockii beta-glucosidase variant
MIKLAKFPRDFVWGTATSSYQIEGAVNEDGRTPSIWDTFSKTEGKTYKGHTGDVACDHYHRYKEDVEILKEIGVKAYRFSIAWTRIFPEEGKYNPKGMDFYKKLIDELQKRDIVPAATIYHWDLPQWAFDIGGGWLNRESIKWYVEYATRLFEELGDAVPLWITHNEPWCSSILSYGIGEHAPGHKNYREALIAAHHILLSHGEAVKAFREMNIKGSKIGITLNLTPAYPASEKEEDKLAAQYADGFANRWFLDPIFKGNYPEDMMELYSKIIGEFDFIKEGDLETISVPIDFLGVNYYTRSVVKYAEDSMLKAENVPGPGKRTEMGWEVSPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTSQKRILKDSALWYKEVILDDGIEDQ

SEQ ID NO: 33 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttgacgaagatggtcgtaccccgagtatctgggataccttctctaaaacggaggggaaaacttacaaaggtcatacaggtgatgtcgcatgtgaccattatcatcgctacaaagaggatgtcgagatcttaaaagaaattggagtaaaggcctaccgcttctcgattgcttggacgcgtattttcccagaagaaggcaaatacaatccaaaaggcatggatttttacaagaagttgatcgatgaactccagaagcgcgatattgtccccgcggcgacgatttatcactgggatttaccgcagtgggcgtttgataaaggcggtggctggttaaatcgtgaaagcatcaaatggtatgtagaatatgcaaccaaactttttgaggaattgggtgacgccattcctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgtatcccgccagcgagaaagaagaagataagttggcggcgcagtacgccgacggctttgctaaccgttggttcctcgacccgatcttcaaaggaaactacccggaggatatgatggagttatacagcaagatcatcggcgagtttgattttatcaaagaaggcgacttggaaacgatctctgtcccaatcgactttttaggtgttaactattatacgcgctccatcgtcaaatacgctgaagactctatgcttaaagccgaaaacgtacctggtccgggcaaacgcaccgagatggggtgggaagtttcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaatggttacttcgtgtggtcattgatggataattttgaatgggcacacgggtattccaaacgttttggcattgtttatgtagattatacttcgcagaaacgcatccttaaagatagtgcgttgtggtacaaagaagtgattcttgatgacggcattgaagaccagtga

SEQ ID NO: 34 - protein, 451 aa, Artificial Sequence
  T. brockii beta-glucosidase variant
MIKLAKFPRDFVWGTATSSYQIEGAVDEDGRTPSIWDTFSKTEGKTYKGHTGDVACDHYHRYKEDVEILKEIGVKAYRFSIAWTRIFPEEGKYNPKGMDFYKKLIDELQKRDIVPAATIYHWDLPQWAFDKGGGWLNRESIKWYVEYATKLFEELGDAIPLWITHNEPWCSSILSYGIGEHAPGHKNYREALIAAHHILLSHGEAVKAFREMNIKGSKIGITLNLTPAYPASEKEEDKLAAQYADGFANRWFLDPIFKGNYPEDMMELYSKIIGEFDFIKEGDLETISVPIDFLGVNYYTRSIVKYAEDSMLKAENVPGPGKRTEMGWEVSPESLYDLLKRLDREYTKLPMYITENGAAFKDEVTEDGRVHDDERIEYIKEHLKAAAKFIGEGGNLNGYFVWSLMDNFEWAHGYSKRFGIVYVDYTSQKRILKDSALWYKEVILDDGIEDQ

SEQ ID NO: 35 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttaatgaagatggtcgtaccccgagtatctgggataccttctctaaaacggaggggaaaacttacaaaggtcatacaggtgatgtcgcatgtgaccattatcatcgctacaaagaggatgtcgagatcttaaaagaaattggagtaaaggcctaccgcttctcgattgcttggacgcgtattttcccagaagaaggcaaatacaatccaaaaggcatggatttttacaagaagttgatcgatgaactccagaagcgcgatattgtccccgcggcgacgatttatcactgggatttaccgcagtgggcgtacgatataggcggtggctggttaaatcgtgaaagcatcaaatggtatgtagaatatgcaaccaaactttttgaggaattgggtgacgccattcctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgtatcccgccagcgagaaagaagaagataagatggcggcgcagtacgccgacggctttgctaaccgttggttcctcgacccgatcttcaaaggaaactacccggaagatatgatggagttatacagcaagatcatcggcgagtttgattttatcaaagaaggcgacttggaagcgatctctgtcccaatcgactttttaggtgttaactattatacgcgctccgtcgtcaaatacgctgaagactctatgcttaaagccgaaaacgtacctggtccgggcaaacgcaccgagatggggtgggaagtttcgccggagtcattatatgaccttcttaagcggctcgaccgtgagtataccaaattacctatgtacattactgaaaacggcgctgcattcaaagacgaagttactgaagatgggcgcgttcacgatgatgagcgtatagaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatacttcgcagaaacgcatccttaaagatagtgcgttgtggtacaaagaagtgattcttgatgacggcattgaagactaatga

SEQ ID NO: 36 - protein, 450 aa, Artificial Sequence
  T. brockii beta-glucosidase variant
MIKLAKFPRDFVWGTATSSYQIEGAVNEDGRTPSIWDTFSKTEGKTYKGHTGDVACDHYHRYKEDVEILKEIGVKAYRFSIAWTRIFPEEGKYNPKGMDFYKKLIDELQKRDIVPAATIYHWDLPQWAYDIGGGWLNRESIKWYVEYATKLFEELGDAIPLWITHNEPWCSSILSYGIGEHAPGHKNYREALIAAHHILLSHGEAVKAFREMNIKGSKIGITLNLTPAYPASEKEEDKMAAQYADGFANRWFLDPIFKGNYPEDMMELYSKIIGEFDFIKEGDLEAISVPIDFLGVNYYTRSVVKYAEDSMLKAENVPGPGKRTEMGWEVSPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTSQKRILKDSALWYKEVILDDGIED

SEQ ID NO: 37 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttgacgaagatggtcgtaccccgagtatctgggataccttctctaaaacggaggggaaaacttacaaaggtcatacaggtgatgtcgcatgtgaccattatcatcgctacaaagaggatgtcgagatcttaaaagaaattggagtaaaggcctaccgcttctcgattgcttggacgcgtattttcccagaagaaggcaaatacaatccaaaaggcatggatttttacaagaagttgatcgatgaactccagaagcgcgatattgtccccgcggcgacgatttatcactgggatttaccgcagtgggcgtacgatataggcggtgactggttaaatcgtgaaagcatcaaatggtatgtagaatatgcaaccaaactttttgaggaattgggtgacgccgtacctctctggatcacacataatgaaccgtggtgttcaagtattttgagctatggtattggtgagcatgcgcctggccataaaaactatcgcgaagcactcattgctgcacaccatattttgttgtcgtatggtgaagccgtgaaagcattccgggagatgaatatcaaagggtccaagattggaatcaccctcaatctcaccccagcgtatcccgccagcgagaaagaagaagataagatggcggcgcagtacgccgacggctttgctaaccgttggttcctcgacccgatcttcaaaggaaactacccggaagatatgatggagttatacagcaagatcatcggcgagtttgattttatcaaagaaggcgacttggaaacgatctctgtcccaatcgactttttaggtgttaactattatacgcgctccgtcgtcaaatacgctgaagactctatgcttaaagccgaaaacgtacctggtccgggcaaacgcaccgagatggggtgggaagtttcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatactacccagaaacgcatccttaaagatagtgcgttgtggtacaaagaagtgattcttgatgacggcattgaagaccagtga

SEQ ID NO: 38 - protein, 451 aa, Artificial Sequence
  T. brockii beta-glucosidase variant
MIKLAKFPRDFVWGTATSSYQIEGAVDEDGRTPSIWDTFSKTEGKTYKGHTGDVACDHYHRYKEDVEILKEIGVKAYRFSIAWTRIFPEEGKYNPKGMDFYKKLIDELQKRDIVPAATIYHWDLPQWAYDIGGDWLNRESIKWYVEYATKLFEELGDAVPLWITHNEPWCSSILSYGIGEHAPGHKNYREALIAAHHILLSYGEAVKAFREMNIKGSKIGITLNLTPAYPASEKEEDKMAAQYADGFANRWFLDPIFKGNYPEDMMELYSKIIGEFDFIKEGDLETISVPIDFLGVNYYTRSVVKYAEDSMLKAENVPGPGKRTEMGWEVSPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTTQKRILKDSALWYKEVILDDGIEDQ

SEQ ID NO: 39 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttgacgaagatggtcgtaccccgagtatctgggataccttctctaaaacggaggggaaaactcacaaaggtcatacaggtgatgtcgcatgtgaccattatcatcgctacaaagaggatgtcgagatcttaaaagaaattggagtaaaggcctaccgcttctcgattgcttggacgcgtattttcccagaagaaggcaaatacaatccaaaaggcatggatttttacaagaagttgatcgatgaactccagaagcgcgatattgtccccgcggcgacgatttatcactgggatttaccgcagtgggcgtacgatataggcggtggctggttaaatcgtgaaagcatcaaatggtatgtagaatatgcaaccaaactttttgaggaattgggtgacgccattcctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgtatcccgccagcgagaaagaagaagataagatggcggcgcagtacgccgacggctttgctaaccgttggttcctcgacccgatcttcaaaggaaactacccggaagatatgatggagttatacagcaagatcatcggcgagtttgattttatcaaagaaggcgacttggaaacgatctctgtcccaatcgactttttaggtgttaactattatacgcgctccgtcgtcaaatacgctgaagactctatgcttaaagccgaaaacgtacctggtccgggcaaacgcaccgagatggggtgggaagtttcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatacttcgcagaaacgcatccttaaagatagtgcgttgtggtacaaagaagtgattcttgatgacggcattgaagactaatga

SEQ ID NO: 40 - protein, 450 aa, Artificial Sequence
  T. brockii beta-glucosidase variant
MIKLAKFPRDFVWGTATSSYQIEGAVDEDGRTPSIWDTFSKTEGKTHKGHTGDVACDHYHRYKEDVEILKEIGVKAYRFSIAWTRIFPEEGKYNPKGMDFYKKLIDELQKRDIVPAATIYHWDLPQWAYDIGGGWLNRESIKWYVEYATKLFEELGDAIPLWITHNEPWCSSILSYGIGEHAPGHKNYREALIAAHHILLSHGEAVKAFREMNIKGSKIGITLNLTPAYPASEKEEDKMAAQYADGFANRWFLDPIFKGNYPEDMMELYSKIIGEFDFIKEGDLETISVPIDFLGVNYYTRSVVKYAEDSMLKAENVPGPGKRTEMGWEVSPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTSQKRILKDSALWYKEVILDDGIED

SEQ ID NO: 41 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttaatgaagatggtcgtaccccgagtatctgggataccttctctaaaacggaggggaaaacttacaaaggtcatacaggtgatgtcgcatgtgaccattatcatcgctacaaagaggatgtcgagatcttaaaagaaattggagtaaaggcctaccgcttctcgattgcttggccacgtattttcccagaagaaggcaaatacaatccaaaaggcatggatttttacaagaagttgatcgatgaactccagaagcgcgatatcgtccccgcggcgacgatttatcactgggatttaccgcagtgggcgtacgatataggcggtggctggttaaatcgtgaaagcatcgaatggtatgtagaatatgcaaccaaactttttgaggaattgggtgacgccgtacctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgtatcccgccagcgagaaagaagaagataagatggcggcgcagtacgccgacggctttgctaaccgttggttcctcgacccgatcttcaaaggaaactacccggaagatatgatggagttatacagcaagatcatcggcgagtttgattttatcaaagaaggcgacttggaaacgatctctgtcccaatcgactttttaggtgttaactattatacgcgctccgtcgtcaaatacgatgaagactctatgcttaaagccgaaaacgtacctggtccgggcaaacgcaccgagatggggtgggaagtttcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatacttcgcagaaacgcatccttaaagatagtgcgttgtggtacaaagaagtgattcttgatgacggcattgaagaccagtga

SEQ ID NO: 42 - protein, 451 aa, Artificial Sequence
  T. brockii beta-glucosidase variant
MIKLAKFPRDFVWGTATSSYQIEGAVNEDGRTPSIWDTFSKTEGKTYKGHTGDVACDHYHRYKEDVEILKEIGVKAYRFSIAWPRIFPEEGKYNPKGMDFYKKLIDELQKRDIVPAATIYHWDLPQWAYDIGGGWLNRESIEWYVEYATKLFEELGDAVPLWITHNEPWCSSILSYGIGEHAPGHKNYREALIAAHHILLSHGEAVKAFREMNIKGSKIGITLNLTPAYPASEKEEDKMAAQYADGFANRWFLDPIFKGNYPEDMMELYSKIIGEFDFIKEGDLETISVPIDFLGVNYYTRSVVKYDEDSMLKAENVPGPGKRTEMGWEVSPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTSQKRILKDSALWYKEVILDDGIEDQ

SEQ ID NO: 43 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttgacgaagatggtcgtaccccgagtatctgggataccttctctaaaacggaggggaaaacttacaaaggtcatacaggtgatgtcgcatgtgaccattatcatcgctacaaagaggatgtcgagatcttaaaagaaattggagtaaaggcctaccgcttctcgattgcttggacgcgtattttcccagaagaaggcaaatacaatccaaaaggcatggatttttacaagaagttgatcgatgaactccagaagcgcgatattgtccccgcggcgacgatttatcactgggatttaccgcagtgggcgtttgataaaggcggtggctggttaaatcgtgaaagcatcaaatggtatgtagaatatgcaaccaaactttttgaggaattgggtgacgccgtacctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgtatcccgccagcgagaaagaagaagataagatggcggcgcagtacgccgacggctttgctaaccgttggttcctcgacccgatcttcaaaggaaactacccggaagatatgatggagttatacagcaagatcatcggcgagtttgattttatcaaagaaggcgacttggaaacgatctctgtcccaatcgactttttaggtgttaactattatacgcgctccatcgtcaaatacgctgaagactctatgcttaaagccgaaaacgtacctggtccgggcaaacgcaccgagatggggtgggaagtttcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatacttcgcagaaacgcatccttaaagatagtgcgttgtggtacaaagaagtgattcttgatgacggcattgaagactaatga

SEQ ID NO: 44 - protein, 450 aa, Artificial Sequence
  T. brockii beta-glucosidase variant
MIKLAKFPRDFVWGTATSSYQIEGAVDEDGRTPSIWDTFSKTEGKTYKGHTGDVACDHYHRYKEDVEILKEIGVKAYRFSIAWTRIFPEEGKYNPKGMDFYKKLIDELQKRDIVPAATIYHWDLPQWAFDKGGGWLNRESIKWYVEYATKLFEELGDAVPLWITHNEPWCSSILSYGIGEHAPGHKNYREALIAAHHILLSHGEAVKAFREMNIKGSKIGITLNLTPAYPASEKEEDKMAAQYADGFANRWFLDPIFKGNYPEDMMELYSKIIGEFDFIKEGDLETISVPIDFLGVNYYTRSIVKYAEDSMLKAENVPGPGKRTEMGWEVSPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTSQKRILKDSALWYKEVILDDGIED

SEQ ID NO: 45 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttaatgaagatggtcgtaccccgggtatctgggataccttctctaaaacggaggggaaaacttacaaaggtcatacaggtgatgtcgcatgtgaccattatcatcgctacaaagaggatgtcgagatcttaaaagaaattggagtaaaggcctaccgcttctcgattgcttggacgcgtattttcccagaagaaggcaaatacaatccaaaaggcatggatttttacaagaagttgatcgatgaactccagaagcgcgatattgtccccgcggcgacgatttatcactgggatttaccgcagtgggcgtttgataaaggcggtggctggttaaatcgtgaaagcatcaaatggtatgtagaatatgcaaccaaactttttgaggaattgggtgacgccattcctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgtatcccgccagcgagaaagaagaagataagttggcggcgcagtacgccgacggctttgctaaccgttggttcctcgacccgatcttcaaaggaaactacccggaagatatgatggagttatacagcaagatcatcggcgagtttgattttatcaaagaaggcgacttggaaacgatctctgtcccaatcgactttttaggtgttaactattatacgcgctccgtcgtcaaatacgctgaagactctatgcttaaagccgaaaacgtacctggtccgggcaaacgcaccgagatggggtgggaagtttcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggcggcaaccttaaaggttacttcgtgtggtcattgatggataattttgaatgggcacacgggtattccaaacgttttggcattgtttatgtagattatacttcgcagaaacgcatccttaaagatagtgcgttgtggtacaaagaagtgattcttgatgacggcattgaagaccagtga

SEQ ID NO: 46 - protein, 451 aa, Artificial Sequence
  T. brockii beta-glucosidase variant
MIKLAKFPRDFVWGTATSSYQIEGAVNEDGRTPGIWDTFSKTEGKTYKGHTGDVACDHYHRYKEDVEILKEIGVKAYRFSIAWTRIFPEEGKYNPKGMDFYKKLIDELQKRDIVPAATIYHWDLPQWAFDKGGGWLNRESIKWYVEYATKLFEELGDAIPLWITHNEPWCSSILSYGIGEHAPGHKNYREALIAAHHILLSHGEAVKAFREMNIKGSKIGITLNLTPAYPASEKEEDKLAAQYADGFANRWFLDPIFKGNYPEDMMELYSKIIGEFDFIKEGDLETISVPIDFLGVNYYTRSVVKYAEDSMLKAENVPGPGKRTEMGWEVSPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTSQKRILKDSALWYKEVILDDGIEDQ

SEQ ID NO: 47 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttgacgaagatggtcgtaccccgagtatctgggataccttctctaaaacggaggggaaaacttacaaaggtcatacaggtgatgtcgcatgtgaccattatcatcgctacaaaaaggatgtcgagatcttaaaagaaattggagtaaaggcctaccgcttctcgattgcttggacgcgtattttcccagaagaaggcaaatacaatccaaaaggcatggatttttacaagaagttgatcgatgaactccagaagcgcgatattgtccccgcggcgacgatttatcactgggatttaccgcagtgggcgtttgatattggcggtggctggttaaatcgtgaaagcatcaaatggtatgtagaatatgcaaccaaactttttgaggaattgggtgacgccattcctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgtatcccgccagcgagaaagaagaagataagttggcggcgcagtacgccgacggctttgctaaccgttggttcctcgacccgatcttcaaaggaaactacccggaagatatgatggagttatacagcaagatcatcggcgagtttgattttatcaaagaaggcgacttggaaacgatctctgtcccaatcgactttttaggtgttaactattatacgcgctccgtcgtcaaatacgctgaagactctatgcttaaagccgaaaacgtacctggtccgggcaaacgcaccgagatggggtgggaagtttcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtggattatactacccagaaacgcatccttaaagatagtgcgttgtggtacaaagaagtgattcttgatgacggcattgaagaccagtga

SEQ ID NO: 48 - protein, 451 aa, Artificial Sequence
  T. brockii beta-glucosidase variant
MIKLAKFPRDFVWGTATSSYQIEGAVDEDGRTPSIWDTFSKTEGKTYKGHTGDVACDHYHRYKKDVEILKEIGVKAYRFSIAWTRIFPEEGKYNPKGMDFYKKLIDELQKRDIVPAATIYHWDLPQWAFDIGGGWLNRESIKWYVEYATKLFEELGDAIPLWITHNEPWCSSILSYGIGEHAPGHKNYREALIAAHHILLSHGEAVKAFREMNIKGSKIGITLNLTPAYPASEKEEDKLAAQYADGFANRWFLDPIFKGNYPEDMMELYSKIIGEFDFIKEGDLETISVPIDFLGVNYYTRSVVKYAEDSMLKAENVPGPGKRTEMGWEVSPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTTQKRILKDSALWYKEVILDDGIEDQ

SEQ ID NO: 49 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttaatgaagatggtcgtaccccgagtatctgggataccttctctaaaacggaggggaaaacttacaaaggtcatacaggtgatgtcgcatgtgaccattatcatcgctacaaaaaggatgtcgagatcttaaaagaaattggagtaaaggcctaccgcttctcgattgcttggacgcgtattttcccagaagaaggcaaatacaatccaaaaggcatggatttttacaagaagttgatcgatgaactccagaagcgcgatattgtccccgcggcgacgatttatcactgggatttaccgcagtgggcgtacgatataggcggtggctggttaaatcgtgaaagcatcaaatggtatgtagaatatgcaaccaaactttttgaggaattgggtgacgccgtacctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcgaagggtccaagattggaatcaccctcaatctcaccccagcgtatcccgccagcgagaaagaagaagataagttggcggcgcagtacgccgacggctttgctaaccgttggttcctcgacccgatcttcaaaggaaactacccggaagatatgatggagttatacagcaagatcatcggcgagtttgattttatcaaagaaggcgacttggaaacgatctctgtcccaatcgactttttaggtgttaactattatacgcgctccatcgtcaaatacgatgaagactctatgcttaaagccgaaaacgtacctggtccgggcaaacgcaccgagatggggtgggaagtttcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatacttcgcagaaacgcatccttaaagatagtgcgttgtggtacaaagaagtgattcttgatgacggcattgaagaccagtga

SEQ ID NO: 50 - protein, 451 aa, Artificial Sequence
  T. brockii beta-glucosidase variant
MIKLAKFPRDFVWGTATSSYQIEGAVNEDGRTPSIWDTFSKTEGKTYKGHTGDVACDHYHRYKKDVEILKEIGVKAYRFSIAWTRIFPEEGKYNPKGMDFYKKLIDELQKRDIVPAATIYHWDLPQWAYDIGGGWLNRESIKWYVEYATKLFEELGDAVPLWITHNEPWCSSILSYGIGEHAPGHKNYREALIAAHHILLSHGEAVKAFREMNIEGSKIGITLNLTPAYPASEKEEDKLAAQYADGFANRWFLDPIFKGNYPEDMMELYSKIIGEFDFIKEGDLETISVPIDFLGVNYYTRSIVKYDEDSMLKAENVPGPGKRTEMGWEVSPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTSQKRILKDSALWYKEVILDDGIEDQ

SEQ ID NO: 51 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttgacgaagatggtcgtaccccgagtatctgggataccttctctaaaacggaggggaaaacttacaaaggtcatacaggtgatgtcgcatgtgaccattatcatcgctacaaagaggatgtcgagatcttaaaagaaattggagtaaaggcctaccgcttctcgattgcttggacacgtattttcccagaagaaggcaaatacaatccaaaaggcatggatttttacaagaagttgatcgatgaactccagaagcgcgatattgtccccgcggcgacgatttatcactgggatttaccgcagtgggcgtacgatataggcggtggctggttaaatcgtgaaagcatcaaatggtatgtagaatatgcaaccaaactttttgaggaattgggtgacgccattcctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgtatcccgccagcgagaaagaagaagataagatggcggcgcagtacgccgacggctttgctaaccgttggttcctcggcccgatcttcaaaggaaactacccggaagatatgatggagttatacagcaagatcatcggcgagtttgattttatcaaagaaggcgacttggaaacgatctctgtcccaatcgactttttaggtgttaactattatacgcgctccgtcgtcaaatacgctgaagactctatgcttaaagccgaaaacgtacctggtccgggcaaacgcaccgagatggggttggaagtctcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatactacccagaatcgcatccttaaagatagtgcgttgtggtacaaagaagtgattcttgatgacggcattgaagaccagtga

SEQ ID NO: 52 - protein, 451 aa, Artificial Sequence
  T. brockii beta-glucosidase variant
MIKLAKFPRDFVWGTATSSYQIEGAVDEDGRTPSIWDTFSKTEGKTYKGHTGDVACDHYHRYKEDVEILKEIGVKAYRFSIAWTRIFPEEGKYNPKGMDFYKKLIDELQKRDIVPAATIYHWDLPQWAYDIGGGWLNRESIKWYVEYATKLFEELGDAIPLWITHNEPWCSSILSYGIGEHAPGHKNYREALIAAHHILLSHGEAVKAFREMNIKGSKIGITLNLTPAYPASEKEEDKMAAQYADGFANRWFLGPIFKGNYPEDMMELYSKIIGEFDFIKEGDLETISVPIDFLGVNYYTRSVVKYAEDSMLKAENVPGPGKRTEMGLEVSPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTTQNRILKDSALWYKEVILDDGIEDQ

SEQ ID NO: 53 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttgacgaagatggtcgtaccccgagtatctgggataccttctctaaaacggaggggaaaacttacaaaggtcatacaggtgatgtcgcatgtgaccattatcatcgctacaaagaggatgtcgagatcttaaaagaaattggagtaaaggcctaccgcttctcgattgcttggacgcgtattttcccagaagaaggcaaatacaatccaaaaggcatggatttttacaagaagttgatcgatgaactccagaagcgcgatattgtccccgcggcgacgatttatcactgggatttaccgcagtgggcgtacgatataggcggtggctggttaaatcgtgaaagcatcaaatggtatgtagaatatgcaaccaaactttttgaggaattgggtgacgccgtacctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgtatcccgccagcgagaaagaagaagataagttggcggcgcagtacgccgacggctttgctaaccgttggttcctcgacccgatcttcaaaggaaactacccggaagatatgatggagttatacagcaagatcatcggcgagtttgattttatcaaagaaggcgacttggaaacgatctctgtcccaatcgactttttaggtgttaactattatacgcgctccatcgtcaaatacgatgaagactctatgcttaaagccgaaaacgtacctggtccgggcaaacgcaccgagatggggtgggaagtttcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatactacccagaaacgcatccttaaagatagtgcgttgtggtacaaagaagtgattcttgatgacggcattgaagactaatga

SEQ ID NO: 54 - protein, 450 aa, Artificial Sequence
  T. brockii beta-glucosidase variant
MIKLAKFPRDFVWGTATSSYQIEGAVDEDGRTPSIWDTFSKTEGKTYKGHTGDVACDHYHRYKEDVEILKEIGVKAYRFSIAWTRIFPEEGKYNPKGMDFYKKLIDELQKRDIVPAATIYHWDLPQWAYDIGGGWLNRESIKWYVEYATKLFEELGDAVPLWITHNEPWCSSILSYGIGEHAPGHKNYREALIAAHHILLSHGEAVKAFREMNIKGSKIGITLNLTPAYPASEKEEDKLAAQYADGFANRWFLDPIFKGNYPEDMMELYSKIIGEFDFIKEGDLETISVPIDFLGVNYYTRSIVKYDEDSMLKAENVPGPGKRTEMGWEVSPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTTQKRILKDSALWYKEVILDDGIED

SEQ ID NO: 55 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttgacgaagatggtcgtaccccgagtatctgggataccttctctaaaacggaggggaaaacttacaaaggtcatacaggtgatgtcgcatgtgaccattatcatcgctacaaagaggatgtcgagatcttaaaagaaattggagtaaaggcataccgcttctcgattgcttggacgcgtattttcccagaagaaggcaaatacaatccgaaaggcatggatttttacaagaagttgatcgatgaactccagaagcgcgatattgtccccgcggcgacgatttatcactgggatttaccgcagtgggcgtttgataaaggcggtgactggttaaatcgtgaaagcatcaaatggtatgtagaatatgcaaccaaactttttgaggaattgggtgacgccgtacctctctggatcacacataatgaaccgtggtgttcaagtattttgagctatggtattggtgagcatgcgcctggccataaaaactatcgcgaagcactcattgctgcacaccatattttgttgtcgcacggtgaaggcgtgaaagcattccgggagatgaatatcaaagggtccaagattggaatcaccctcaatctcaccccagcgtatcccgccagcgagaaagaagaagataagatggcggcgcagtacgccgacggctttgctaaccgttggttcctcgacccgatcttcaaaggaaactacccggaagatatgatggagttatacagcaagatcatcggcgagtttgattttatcaaagaaggcgacttggaaacgatctctgtcccaatcgactttttaggtgttaactattatacgcgctccgtcgtcaaatacgctgaagactctatgcttaaagccgaaaacgtacctggtccgggcaaacgcaccgagatggggtgggaagtttcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatacttcgcagaaacgcatccttaaagatagtgcgttgtggtacaaagaagtgattcttgatgacggcattgaagaccagtga

SEQ ID NO: 56 - protein, 451 aa, Artificial Sequence
  T. brockii beta-glucosidase variant
MIKLAKFPRDFVWGTATSSYQIEGAVDEDGRTPSIWDTFSKTEGKTYKGHTGDVACDHYHRYKEDVEILKEIGVKAYRFSIAWTRIFPEEGKYNPKGMDFYKKLIDELQKRDIVPAATIYHWDLPQWAFDKGGDWLNRESIKWYVEYATKLFEELGDAVPLWITHNEPWCSSILSYGIGEHAPGHKNYREALIAAHHILLSHGEGVKAFREMNIKGSKIGITLNLTPAYPASEKEEDKMAAQYADGFANRWFLDPIFKGNYPEDMMELYSKIIGEFDFIKEGDLETISVPIDFLGVNYYTRSVVKYAEDSMLKAENVPGPGKRTEMGWEVSPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTSQKRILKDSALWYKEVILDDGIEDQ

SEQ ID NO: 57 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttaatgaagatggtcgtaccccgagtatctgggataccttctctaaaacggaggggaaaacttacaaaggtcatacaggtgatgtcgcatgtgaccattatcatcgctacaaagaggatgtcgagatcttaaaagaaattggagtaaaggcctaccgcttctcgattgcttggacgcgtattttcccagaagaaggcaaatacaatccaaaaggcatggatttttacaagaagttgatcgatgaactccagaagcgcgatattgtccccgcggcgacgatttatcactgggatttaccgcagtgggcgtttgataaaggcggtggctggttaaatcgtgaaagcatcaaatggtatgtagaatatgcaaccaaactttttgaggaattgggtgacgccgtacctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgtatcccgccagcgagaaagaagaagataagatggcggcgcagtacgccgacggctttgctaaccgttggttcctcgacccgatcttcaaaggaaactacccggaagatatgatggagttatacagcaagatcatcggcgagtttgattttatcaaagaaggcgacttggaaacgatctctgtcccaatcgactttttaggtgttaactattatacgcgctccatcgtcaaatacgatgaagactctatgcttaaagccgaaaacgtacctggtccgggcaaacgcaccgagatggggtgggaagtttcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatactacccagaaacgcatccttaaagatagtgcgttgtggtacaaagaagtgattcttgatgacggcattgaagactaatga

SEQ ID NO: 58 - protein, 450 aa, Artificial Sequence
  T. brockii beta-glucosidase variant
MIKLAKFPRDFVWGTATSSYQIEGAVNEDGRTPSIWDTFSKTEGKTYKGHTGDVACDHYHRYKEDVEILKEIGVKAYRFSIAWTRIFPEEGKYNPKGMDFYKKLIDELQKRDIVPAATIYHWDLPQWAFDKGGGWLNRESIKWYVEYATKLFEELGDAVPLWITHNEPWCSSILSYGIGEHAPGHKNYREALIAAHHILLSHGEAVKAFREMNIKGSKIGITLNLTPAYPASEKEEDKMAAQYADGFANRWFLDPIFKGNYPEDMMELYSKIIGEFDFIKEGDLETISVPIDFLGVNYYTRSIVKYDEDSMLKAENVPGPGKRTEMGWEVSPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTTQKRILKDSALWYKEVILDDGIED

SEQ ID NO: 59 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttgacgaagatggtcgtaccccgagtatctgggataccttctctaaaacggaggggaaaacttacaaaggtcatacaggtgatgtcgcatgtgaccattatcatcgctacaaaaaggatgtcgagatcttaaaagaaattggagtaaaggcctaccgcttctcgattgcttggacgcgtattttcccagaagaaggcaaatacaatccaaaaggcatggatttttacaagaagttgatcgatgaactccagaagcgcgatattgtccccgcggcgacgatttatcactgggatttaccgcagtgggcgtacgatataggcggtggctggttaaatcgtgaaagcatcaaatggtatgtagaatatgcaaccaaactttttgaggaattgggtgacgccgtacctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgtatcccgccagcgagaaagaagaagataagttggcggcgcagtacgccgacggctttgctaaccgttggttcctcgacccgatcttcaaaggaaactacccggaagatatgatggagttatacagcaagatcatcggcgagtttgattttatcaaagaaggcgacttggaaacgatctctgtcccaatcgactttttaggtgttaactattatacgcgctccatcgtcaaatacgctgaagactctatgcttaaagccgaaaacgtacctggtccgggcaaacgcaccgagatggggtgggaagtttcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatacttcgcagaaacgcatccttaaagatagtgcgttgtggtacaaagaagtgattcttgatgacggcattgaagaccagtga

SEQ ID NO: 60 - protein, 451 aa, Artificial Sequence
  T. brockii beta-glucosidase variant
MIKLAKFPRDFVWGTATSSYQIEGAVDEDGRTPSIWDTFSKTEGKTYKGHTGDVACDHYHRYKKDVEILKEIGVKAYRFSIAWTRIFPEEGKYNPKGMDFYKKLIDELQKRDIVPAATIYHWDLPQWAYDIGGGWLNRESIKWYVEYATKLFEELGDAVPLWITHNEPWCSSILSYGIGEHAPGHKNYREALIAAHHILLSHGEAVKAFREMNIKGSKIGITLNLTPAYPASEKEEDKLAAQYADGFANRWFLDPIFKGNYPEDMMELYSKIIGEFDFIKEGDLETISVPIDFLGVNYYTRSIVKYAEDSMLKAENVPGPGKRTEMGWEVSPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTSQKRILKDSALWYKEVILDDGIEDQ

SEQ ID NO: 61 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttgacgaagatggtcgtaccccgagtatctgggataccttctctaaaacggaggggaaaacttacaaaggtcatacaggtgatgtcgcatgtgaccattatcatcgctacaaaaaggatgtcgagatcttaaaagaaattggagtaaaggcctaccgcttctcgattgcttggacgcgtattttcccagaagaaggcaaatacaatccaaaaggcatggatttttacaagaagttgatcgatgaactccagaagcgcgatattgtccccgcggcgacgatttatcactgggatttaccgcagtgggcgtacgatataggcggtggctggttaaatcgtgaaagcatcaaatggtatgtagaatatgcaaccaaactttttgaggaattgggtgacgccatacctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgtatcccgccagcgagaaagaagaagataagttggcggcgcagtacgccgacggctttgctaaccgttggttcctcgacccgatcttcaaaggaaactacccggaagatatgatggagttatacagcaagatcatcggcgagtttgattttatcaaagaaggcgacttggaaacgatctctgtcccaatcgactttttaggtgttaactattatacgcgctccgtcgtcaaatacgctgaagactctatgcttaaagccgaaaacgtacctggtccgggcaaacgcaccgagatggggttggaagtctcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatacttcgcagaaacgcatccttaaagacagtgcgttgtggtacaaagaagtgattcttgatgacggcattgaagaccagtga

SEQ ID NO: 62 - protein, 451 aa, Artificial Sequence
  T. brockii beta-glucosidase variant
MIKLAKFPRDFVWGTATSSYQIEGAVDEDGRTPSIWDTFSKTEGKTYKGHTGDVACDHYHRYKKDVEILKEIGVKAYRFSIAWTRIFPEEGKYNPKGMDFYKKLIDELQKRDIVPAATIYHWDLPQWAYDIGGGWLNRESIKWYVEYATKLFEELGDAIPLWITHNEPWCSSILSYGIGEHAPGHKNYREALIAAHHILLSHGEAVKAFREMNIKGSKIGITLNLTPAYPASEKEEDKLAAQYADGFANRWFLDPIFKGNYPEDMMELYSKIIGEFDFIKEGDLETISVPIDFLGVNYYTRSVVKYAEDSMLKAENVPGPGKRTEMGLEVSPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTSQKRILKDSALWYKEVILDDGIEDQ

SEQ ID NO: 63 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttaatgaagatggtcgtaccccgagtatctgggataccttctctaaaacggaggggaaaacttacaaaggtcatacaggtgatgtcgcatgtgaccattatcatcgctacaaagaggatgtcgagatcttaaaagaaattggagtaaaggcctaccgcttctcgattgcttggacgcgtattttcccagaagaaggcaaatacaatccaaaaggcatggatttttacaagaagttgatcgatgaactccagaagcgcgatattgtccccgcggcgacgatttatcactgggatttaccgcagtgggcgtatgatattggcggtggctggttaaatcgtgaaagcatcaaatggtatgtagaatatgcaaccaaactttttgaggaattgggtgacgccgtacctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgtatcccgccagcgagaaagaagaagataagatggcggcgcagtacgccgacggctttgctaaccgttggttcctcgacccgatcttcaaaggaaactacccggaagatatgatggagttatacagcaagatcatcggcgagtttgattttatcaaagaaggcgacttggaaacgatctctgtcccaatcgactttttaggtgttaactattatacgcgctccgtcgtcaaatacgctgaagactctatgcttaaagccgaaaacgtacctggtccgggcaaacgcaccgagatggggtgggaagtttcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatactacccagaaacgcatccttaaagatagtgcgttgtggtacaaagaagtgattcttgaagagggcattgaagactaatga

SEQ ID NO: 64 - protein, 450 aa, Artificial Sequence
  T. brockii beta-glucosidase variant
MIKLAKFPRDFVWGTATSSYQIEGAVNEDGRTPSIWDTFSKTEGKTYKGHTGDVACDHYHRYKEDVEILKEIGVKAYRFSIAWTRIFPEEGKYNPKGMDFYKKLIDELQKRDIVPAATIYHWDLPQWAYDIGGGWLNRESIKWYVEYATKLFEELGDAVPLWITHNEPWCSSILSYGIGEHAPGHKNYREALIAAHHILLSHGEAVKAFREMNIKGSKIGITLNLTPAYPASEKEEDKMAAQYADGFANRWFLDPIFKGNYPEDMMELYSKIIGEFDFIKEGDLETISVPIDFLGVNYYTRSVVKYAEDSMLKAENVPGPGKRTEMGWEVSPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTTQKRILKDSALWYKEVILEEGIED

SEQ ID NO: 65 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttgacgaagatggtcgtaccccgagtatctgggataccttctctaaaacggaggggaaaacttacaaaggtcatacaggtgatgtcgcatgtgaccattatcatcgctacaaagaggatgtcgagatcttaaaagaaattggagtaaaggcctaccgcttctcgattgcttggacgcgtattttcccagaagaaggcaaatacaatccaaaaggcatggatttttacaagaagttgatcgatgaactccagaagcgcgatattgtccccgcggcgacgatttatcactgggatttaccgcagtgggcgtttgataaaggcggtggctggttaaatcgtgaaagcatcaaatggtatgtagaatatgcaaccaaactttttgaggaattgggtgacgccgtacctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgtatcccgccagcgagaaagaagaagataagttggcggcgcagtacgccgacggctttgctaaccgttggttcctcgacccgatcttcaaaggaaactacccggaagatatgatggagttatacagcaagatcatcggcgagtttgattttatcaaagaaggcgacttggaaacgatctctgtcccaatcgactttttaggtgttaactattatacgcgctccgtcgtcaaatacgctgaagactctatgcttaaagccgaaaacgtacctggtccgggcaaacgcaccgagatggggtgggaagtttcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatactacccagaaacgcatccttaaagatagtgcgttgtggtacaaagaagtgattcttgatgacggcattgaagactaatga

SEQ ID NO: 66 - protein, 450 aa, Artificial Sequence
  T. brockii beta-glucosidase variant
MIKLAKFPRDFVWGTATSSYQIEGAVDEDGRTPSIWDTFSKTEGKTYKGHTGDVACDHYHRYKEDVEILKEIGVKAYRFSIAWTRIFPEEGKYNPKGMDFYKKLIDELQKRDIVPAATIYHWDLPQWAFDKGGGWLNRESIKWYVEYATKLFEELGDAVPLWITHNEPWCSSILSYGIGEHAPGHKNYREALIAAHHILLSHGEAVKAFREMNIKGSKIGITLNLTPAYPASEKEEDKLAAQYADGFANRWFLDPIFKGNYPEDMMELYSKIIGEFDFIKEGDLETISVPIDFLGVNYYTRSVVKYAEDSMLKAENVPGPGKRTEMGWEVSPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTTQKRILKDSALWYKEVILDDGIED

SEQ ID NO: 67 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttaatgaagatggtcgtaccccgagtatctgggataccttctctaaaacggaggggaaaacttacaaaggtcatacaggtgatgtcgcatgtgaccattatcatcgctacaaagaggatgtcgagatcttaaaagaaattggagtaaaggcctaccgcttctcgattgcttggacgcgtattttcccagaagaaggcaaatacaatccaaaaggcatggatttttacaagaagttgatcgatgaactccagaagcgcgatattgtccccgcggcgacgatttatcactgggatttaccgcagtgggcgtttgatattggcggtggctggttaaatcgtgaaagcatcaaatggtatgtagaatatgcaaccaaactttttgaggaattgggtgacgccgtacctctctggatcacacataatgaaccgtggtgttcaagtattttgagctatggtattggtgagcatgcgcctggccataaaaactatcgcgaagcactcattgctgcacaccatattttgttgtcgtatggtgaagccgtgaaagcattccgggagatgaatatcaaagggtccaagattggaatcaccctcaatctcaccccagcgtatcccgccagcgagaaagaagaagataagatggcggcgcagtacgccgacggctttgctaaccgttggttcctcgacccggtcttcaaaggaaactacccggaagatatgatggagttatacagcaagatcatcggcgagtttgattttatcaaagaaggcgacttggaaacgatctctgtcccaatcgactttttaggtgttaactattatacgcgctccgtcgtcaaatacgctgaagactctatgcttaaagccgaaaacgtacctggtccgggcaaacgcaccgagatggggtgggaagtttcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatacttcgcagaaacgcatccttaaagatagtgcgttgtggtacaaagaagtgattcttgatgacggcattgaagaccagtga

SEQ ID NO: 68 - protein, 451 aa, Artificial Sequence
  T. brockii beta-glucosidase variant
MIKLAKFPRDFVWGTATSSYQIEGAVNEDGRTPSIWDTFSKTEGKTYKGHTGDVACDHYHRYKEDVEILKEIGVKAYRFSIAWTRIFPEEGKYNPKGMDFYKKLIDELQKRDIVPAATIYHWDLPQWAFDIGGGWLNRESIKWYVEYATKLFEELGDAVPLWITHNEPWCSSILSYGIGEHAPGHKNYREALIAAHHILLSYGEAVKAFREMNIKGSKIGITLNLTPAYPASEKEEDKMAAQYADGFANRWFLDPVFKGNYPEDMMELYSKIIGEFDFIKEGDLETISVPIDFLGVNYYTRSVVKYAEDSMLKAENVPGPGKRTEMGWEVSPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTSQKRILKDSALWYKEVILDDGIEDQ

SEQ ID NO: 69 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttaatgaagatggtcgtaccccgagtatctgggataccttctctaaaacggaggggaaaacttacaaaggtcatacaggtgatgtcgcatgtgaccattatcatcgctacaaagaggatgtcgagatcttaaaagaaattggagtaaaggcctaccgcttctcgattgcttggccacgtattttcccagaagaaggcaaatacaatccaaaaggcatggatttttacaagaagttgatcgatgaactccagaagcgcgatattgtccccgcggcgacgatttatcactgggatttaccgcagtgggcgtacgatataggcggtggctggttaaatcgtgaaagcatcaaatggtatgtagaatatgcaaccaaactttttggggaattgggtgacgccattcctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgtatcccgccagcgagaaagaagaagataagttggcggcgcagtacgccgacggctttgctaaccgttggttcctcgacccgatcttcaaaggaaactacccggaagatatgatggagttatacagcaagatcatcggcgagtttgattttatcaaagaaggcgacttggaaacgatctctgtcccaatcgactttttaggtgttaactattatacgcgctccgtcgtcaaatacgctgaagactctatgcttaaagccgaaaacgtacctggtccgggcaaacgcaccgagatggggtgggaagtttcgccggagtcattatatgaccttcttaagcggctcgaccgtgagtataccaaattacctatgtacattaccgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatactacccagaaacgcatccttaaagatagtgcgttgtggtacaaagaagtgattcttgatgacggcattgaagaccagtga

SEQ ID NO: 70 - protein, 451 aa, Artificial Sequence
  T. brockii beta-glucosidase variant
MIKLAKFPRDFVWGTATSSYQIEGAVNEDGRTPSIWDTFSKTEGKTYKGHTGDVACDHYHRYKEDVEILKEIGVKAYRFSIAWPRIFPEEGKYNPKGMDFYKKLIDELQKRDIVPAATIYHWDLPQWAYDIGGGWLNRESIKWYVEYATKLFGELGDAIPLWITHNEPWCSSILSYGIGEHAPGHKNYREALIAAHHILLSHGEAVKAFREMNIKGSKIGITLNLTPAYPASEKEEDKLAAQYADGFANRWFLDPIFKGNYPEDMMELYSKIIGEFDFIKEGDLETISVPIDFLGVNYYTRSVVKYAEDSMLKAENVPGPGKRTEMGWEVSPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTTQKRILKDSALWYKEVILDDGIEDQ

SEQ ID NO: 71 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttgacgaagatggtcgtaccccgagtatctgggataccttctctaaaacggaggggaaaacttacaaaggtcatacaggtgatgtcgcatgtgaccattatcatcgctacaaaaaggatgtcgagatcttaaaagaaattggagtaaaggcctaccgcttctcggttgcttggccacgtattttcccagaagaaggcaaatacaatccaaaaggcatggatttttacaagaagttgatcgatgaactccagaagcgcgatattgtccccgcggcgacgatttatcactgggatttaccgcagtgggcgtacgatataggcggtggctggttaaatcgtgaaagcatcaaatggtatgtagaatatgctaccaaactttttgaggaattgggtgacgccgtacctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgtatcccgccagcgagaaagaagaagataagatggcggcgcagtacgccgacggctttgccaaccgttggttcctcgacccgatcttcaaaggaaactacccggaagatatgatggagttatacagcaagatcatcggcgagtttgattttatcaaagaaggcgacttggaaacgatctctgtcccaatcgactttttaggtgttaactattatacgcgctccgtcgtcaaatacgctgaagactctatgcttaaagccgaaaacgtacctggtccgggcaaacgcaccgagatggggtgggaagtttcgccggagtcattatatgaccttcttaagcggctcgaccgtgagtataccaaattacctttgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatacttcgcagaaacgcatccttaaagatagtgcgttgtggtacaaagaagtgattcttgatgacggcattgaagaccagtga

SEQ ID NO: 72 - protein, 451 aa, Artificial Sequence
  T. brockii beta-glucosidase variant
MIKLAKFPRDFVWGTATSSYQIEGAVDEDGRTPSIWDTFSKTEGKTYKGHTGDVACDHYHRYKKDVEILKEIGVKAYRFSVAWPRIFPEEGKYNPKGMDFYKKLIDELQKRDIVPAATIYHWDLPQWAYDIGGGWLNRESIKWYVEYATKLFEELGDAVPLWITHNEPWCSSILSYGIGEHAPGHKNYREALIAAHHILLSHGEAVKAFREMNIKGSKIGITLNLTPAYPASEKEEDKMAAQYADGFANRWFLDPIFKGNYPEDMMELYSKIIGEFDFIKEGDLETISVPIDFLGVNYYTRSVVKYAEDSMLKAENVPGPGKRTEMGWEVSPESLYDLLKRLDREYTKLPLYITENGAAFKDEVTEDGRVHDDERIEYIKEHLKAAAKFIGEGGNLKGYFVWSLMDNFEWAHGYSKRFGIVYVDYTSQKRILKDSALWYKEVILDDGIEDQ

SEQ ID NO: 73 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttgacgaagatggtcgtaccccgagtatctgggataccttctctaaaacggaggggaaaacttacaaaggtcatacaggtgatgtcgcatgtgaccattatcatcgctacaaagaggatgtcgagatcttaaaagaaattggagtaaaggcctaccgcttctcgattgcttggccacgtattttcccagaagaaggcaaatacaatccaaaaggcatggatttttacaagaagttgatcgatgaactccagaagcgcgatattgtccccgcggcgacgatttatcactgggatttaccgcagtgggcgtatgatattggcggtgactggttaaatcgtgaaagcatcaaatggtatgtagaatatgcaaccaaactttttgaggaattgggtgacgccgtacctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgtatcccgccagcgagaaagaagaagataagttggcggcgcagtacgccgacggctttgctaaccgttggttcctcgacccgatcttcaaaggaaactacccggaagacatgatggagttatacagcaagatcatcggcgagtttgattttatcaaagaaggcgacttggaaacgatctctgtcccaatcgactttttaggtgttaactattatacgcgctccgtcgtcaaatacgctgaagactctatgcttaaagccgaaaacgtacctggtccgggcaaacgcaccgagatggggtgggaagtttcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatacttcgcagaaacgcatccttaaagatagtgcgttgtggtacaaagaagtgattcttgatgacggcattgaagaccagtga

SEQ ID NO: 74 - protein, 451 aa, Artificial Sequence
  T. brockii beta-glucosidase variant
MIKLAKFPRDFVWGTATSSYQIEGAVDEDGRTPSIWDTFSKTEGKTYKGHTGDVACDHYHRYKEDVEILKEIGVKAYRFSIAWPRIFPEEGKYNPKGMDFYKKLIDELQKRDIVPAATIYHWDLPQWAYDIGGDWLNRESIKWYVEYATKLFEELGDAVPLWITHNEPWCSSILSYGIGEHAPGHKNYREALIAAHHILLSHGEAVKAFREMNIKGSKIGITLNLTPAYPASEKEEDKLAAQYADGFANRWFLDPIFKGNYPEDMMELYSKIIGEFDFIKEGDLETISVPIDFLGVNYYTRSVVKYAEDSMLKAENVPGPGKRTEMGWEVSPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTSQKRILKDSALWYKEVILDDGIEDQ

SEQ ID NO: 75 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttgacgaagatggtcgtaccccgagtatctgggataccttctctaaaacggaggggaaaacttacaaaggtcatacaggtgatgtcgcatgtgaccattatcatcgctacaaaaaggatgtcgagatcttaaaagaaattggagtaaaggcctaccgcttctcgattgcttggacgcgtattttcccagaagaaggcaaatacaatccaaaaggcatggatttttacaagaagttgatcgatgaactccagaagcgcgatattgtccccgcggcgacgatttatcactgggatttaccgcagtgggcgtacgatataggcggtggctggttaaatcgtgaaagcatcaaatggtatgtagaatatgcaaccaaactttttgaggaattgggtgacgccgtacctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgtatcccgccagcgagaaagaagaagataagatggcggcgcagtacgccgacggctttgctaaccgttggttcctcgacccgatcttcaaaggaaactacccggaagatatgatggagttatacagcaagatcatcggcgagtttgattttatcaaagaaggcgacttggaaacgatctctgtcccaatcgactttttaggtgttaactattatacgcgctccgtcgtcaaatacgctgaagactctatgcttaaagccgaaaacgtacctggtccgggcaaacgcaccgagatggggtgggaagtttcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatacttcgcagaaacgcatccttaaagatagtgcgttgtggtacaaagaagtgattcttgatgacggcattgaagaccagtga

SEQ ID NO: 76 - protein, 451 aa, Artificial Sequence
  T. brockii beta-glucosidase variant
MIKLAKFPRDFVWGTATSSYQIEGAVDEDGRTPSIWDTFSKTEGKTYKGHTGDVACDHYHRYKKDVEILKEIGVKAYRFSIAWTRIFPEEGKYNPKGMDFYKKLIDELQKRDIVPAATIYHWDLPQWAYDIGGGWLNRESIKWYVEYATKLFEELGDAVPLWITHNEPWCSSILSYGIGEHAPGHKNYREALIAAHHILLSHGEAVKAFREMNIKGSKIGITLNLTPAYPASEKEEDKMAAQYADGFANRWFLDPIFKGNYPEDMMELYSKIIGEFDFIKEGDLETISVPIDFLGVNYYTRSVVKYAEDSMLKAENVPGPGKRTEMGWEVSPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTSQKRILKDSALWYKEVILDDGIEDQ

SEQ ID NO: 77 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttgacgaagatggtcgtaccccgagtatctgggataccttctctaaaacggaggggaaaacttacaaaggtcatacaggtgatgtcgcatgtgaccattatcatcgctacaaagaggatgtcgagatcttaaaagaaattggagtaaaggcctaccgcttctcgattgcttggacgcgtattttcccagaagaaggcaaatacaatccaaaaggcatggatttttacaagaagttgatcgatgaactccagaagcgcgatattgtccccgcggcgacgatttatcactgggatttaccgcagtgggcgtatgatattggcggtgactggttaaatcgtgaaagcatcaaatggtatgtagaatatgcaaccaaactttttgaggaattgggtgacgccgtacctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgtatcccgccagcgagaaagaagaagataagatggcggcgcagtacgccgacggctttgctaaccgttggttcctcgacccgatcttcaaaggaaactacccggaagatatgatggagttatacagcaagatcatcggcgagtttgattttatcaaagaaggcgacttggaaacgatctctgtcccaatcgactttttaggtgttaactattatacgcgctccgtcgtcaaatacgatgaagactctatgcttaaagccgaaaacgtacctggtccgggcaaacgcaccgagatggggtgggaagtttcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatacttcgcagaaacgcatccttaaagatagtgcgttgtggtacaaagaagtgattcttgatgacggcattgaagaccagtga

SEQ ID NO: 78 - protein, 451 aa, Artificial Sequence
  T. brockii beta-glucosidase variant
MIKLAKFPRDFVWGTATSSYQIEGAVDEDGRTPSIWDTFSKTEGKTYKGHTGDVACDHYHRYKEDVEILKEIGVKAYRFSIAWTRIFPEEGKYNPKGMDFYKKLIDELQKRDIVPAATIYHWDLPQWAYDIGGDWLNRESIKWYVEYATKLFEELGDAVPLWITHNEPWCSSILSYGIGEHAPGHKNYREALIAAHHILLSHGEAVKAFREMNIKGSKIGITLNLTPAYPASEKEEDKMAAQYADGFANRWFLDPIFKGNYPEDMMELYSKIIGEFDFIKEGDLETISVPIDFLGVNYYTRSVVKYDEDSMLKAENVPGPGKRTEMGWEVSPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTSQKRILKDSALWYKEVILDDGIEDQ

SEQ ID NO: 79 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttaatgaagatggtcgtaccccgagtatctgggataccttctctaaaacggaggggaaaacttacaaaggtcatacaggtgatgtcgcatgtgaccattatcatcgctacaaagaggatgtcgagatcttaaaagaaattggagtaaaggcctaccgcttctcgattgcttggacgcgtattttcccagaagaaggcaaatacaatccaaaaggcatggatttttacaagaagttgatcgatgaactccagaagcgcgatattgtccccgcggcgacgatttatcactgggatttaccgcagtgggcgtacgatataggcggtggctggttaaatcgtgaaagcatcaaatggtatgtagaatatgcaaccaaactttttgaggaattgggtgacgccgtacctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgtatcccgccagcgagaaagaagaagataagatggcggcgcagtacgccgacggctttgctaaccgttggttcctcgacccgatcttcaaaggaaactacccggaagatatgatggagttatacagcaagatcatcggcgagtttgattttatcaaagaaggcgacttggaaacgatctctgtcccaatcgactttttaggtgttaactattatacgcgctccgtcgtcaaatacgctgaagactctatgcttaaagccgaaaacgtacctggtccgggcaaacgcaccgagatggggtgggaagtttcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatactacccagaaacgcatccttaaagatagtgcgttgtggtacaaagaagtgattcttgatgacggcattgaagactaatga

SEQ ID NO: 80 - protein, 450 aa, Artificial Sequence
  T. brockii beta-glucosidase variant
MIKLAKFPRDFVWGTATSSYQIEGAVNEDGRTPSIWDTFSKTEGKTYKGHTGDVACDHYHRYKEDVEILKEIGVKAYRFSIAWTRIFPEEGKYNPKGMDFYKKLIDELQKRDIVPAATIYHWDLPQWAYDIGGGWLNRESIKWYVEYATKLFEELGDAVPLWITHNEPWCSSILSYGIGEHAPGHKNYREALIAAHHILLSHGEAVKAFREMNIKGSKIGITLNLTPAYPASEKEEDKMAAQYADGFANRWFLDPIFKGNYPEDMMELYSKIIGEFDFIKEGDLETISVPIDFLGVNYYTRSVVKYAEDSMLKAENVPGPGKRTEMGWEVSPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTTQKRILKDSALWYKEVILDDGIED

SEQ ID NO: 81 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttaatgaagatggtcgtaccccgagtatctgggataccttctctaaaacggaggggaaaacttacaaaggtcatacaggtgatgtcgcatgtgaccattatcatcgctacaaaaaggatgtcgagatcttaaaagaaattggagtaaaggcctaccgcttctcgattgcttggacgcgtattttcccagaagaaggcaaatacaatccaaaaggcatggatttttacaagaagttgatcgatgaactccagaagcgcgatattgtccccgcggcgacgatttatcactgggatttaccgcagtgggcgtatgatattggcggtggctggttaaatcgtgaaagcatcaaatggtatgtagaatatgcaaccaaactttttgaggaattgggtgacgccgtacctctctggatcacacataatgaaccgtggtgttcaagtattttgagctatggtattggtgagcatgcgcctggccataaaaactatcgcgaagcactcattgctgcacaccatattttgttgtcgtatggtgaagccgtgaaagcattccgggagatgaatatcaaagggtccaagattggaatcaccctcaatctcaccccagcgtatcccgccagcgagaaagaagaagataagatggcggcgcagtacgccgacggctttgctaaccgttggttcctcgacccgatcttcaaaggaaactacccggaagatatgatggagttatacagcaagatcatcggcgagtttgattttatcaaagaaggcgacttggaaacgatctctgtcccaatcgactttttaggtgttaactattatacgcgctccgtcgtcaaatacgctgaagactctatgcttaaagccgaaaacgtacctggtccgggcaaacgcaccgagatggggtgggaagtctcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatactacccagaaacgcatccttaaagatagtgcgttgtggtacaaagaagtgattcttgatgacggcattgaagaccagtga

SEQ ID NO: 82 - protein, 451 aa, Artificial Sequence
  T. brockii beta-glucosidase variant
MIKLAKFPRDFVWGTATSSYQIEGAVNEDGRTPSIWDTFSKTEGKTYKGHTGDVACDHYHRYKKDVEILKEIGVKAYRFSIAWTRIFPEEGKYNPKGMDFYKKLIDELQKRDIVPAATIYHWDLPQWAYDIGGGWLNRESIKWYVEYATKLFEELGDAVPLWITHNEPWCSSILSYGIGEHAPGHKNYREALIAAHHILLSYGEAVKAFREMNIKGSKIGITLNLTPAYPASEKEEDKMAAQYADGFANRWFLDPIFKGNYPEDMMELYSKIIGEFDFIKEGDLETISVPIDFLGVNYYTRSVVKYAEDSMLKAENVPGPGKRTEMGWEVSPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTTQKRILKDSALWYKEVILDDGIEDQ

SEQ ID NO: 83 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttaatgaagatggtcgtaccccgagtatctgggataccttctctaaaacggaggggaaaacttacaaaggtcatacaggtgatgtcgcatgtgaccattatcatcgctacaaaaaggatgtcgagatcttaaaagaaattggagtaaaggcctaccgcttctcgattgcttggccacgtattttcccagaagaaggcaaatacaatccaaaaggcatggatttttacaagaagttgatcgatgaactccagaagcgcgatattgtccccgcggcgacgatttatcactgggatttaccgcagtgggcgtttgatattggcggtggctggttaaatcgtgaaagcatcaaatggtatgtagaatatgcaaccaaactttttgaggaattgggtgacgccgtacctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgtatcccgccagcgagaaagaagaagataagatggcggcgcagtacgccgacggctttgctaaccgttggttcctcgacccgatcttcaaaggaaactacccggaagatatgatggagttatacagcaagatcatcggcgagtttgattttatcaaagaaggcgacttggaaacgatctctgtcccaatcgactttttaggtgttaactattatacgcgctccgtcgtcaaatacgatgaagactctatgcttaaagccgaaaacgtacctggtccgggcaaacgcaccgagatggggtgggaagtttcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatactacccagaaacgcatccttaaagatagtgcgttgtggtacaaagaagtgattcttgatgacggcattgaagactaatga

SEQ ID NO: 84 - protein, 450 aa, Artificial Sequence
  T. brockii beta-glucosidase variant
MIKLAKFPRDFVWGTATSSYQIEGAVNEDGRTPSIWDTFSKTEGKTYKGHTGDVACDHYHRYKKDVEILKEIGVKAYRFSIAWPRIFPEEGKYNPKGMDFYKKLIDELQKRDIVPAATIYHWDLPQWAFDIGGGWLNRESIKWYVEYATKLFEELGDAVPLWITHNEPWCSSILSYGIGEHAPGHKNYREALIAAHHILLSHGEAVKAFREMNIKGSKIGITLNLTPAYPASEKEEDKMAAQYADGFANRWFLDPIFKGNYPEDMMELYSKIIGEFDFIKEGDLETISVPIDFLGVNYYTRSVVKYDEDSMLKAENVPGPGKRTEMGWEVSPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTTQKRILKDSALWYKEVILDDGIED

SEQ ID NO: 85 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttgacgaagatggtcgtaccccgagtatctgggataccttctctaaaacggaggggaaaacttacaaaggtcatacaggtgatgtcgcatgtgaccattatcatcgctacaaagaggatgtcgagatcttaaaagaaattggagtaaaggcctaccgcttctcgattgcttggacgcgtattttcccagaagaaggcaaatacaatccaaaaggcatggatttttacaagaagttgatcgatgaactccagaagcgcgatattgtccccgcggcgacgatttatcactgggatttaccgcagtgggcgtttgatattggcggtgactggttaaatcgtgaaagcatcaaatggtatgtagaatatgcaaccaaactttttgaggaattgggtgacgccgtacctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcgccctcaatctcaccccagcgtatcccgccagcgagaaagaagaagataagatggcggcgcagtacgccgacggctttgctaaccgttggttcctcgacccgatcttcaaaggaaactacccggaagatatgatggagttatacagcaagatcatcggcgagtttgattttatcaaagaaggcgacttggaaacgatctctgtcccaatcgactttttaggtgttaactattatacgcgctccgtcgtcaaatacgatgaagactctatgcttaaagccgaaaacgtacctggtccgggcaaacgcaccgagatggggtgggaagtttcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatacttcgcagaaacgcatccttaaagatagtgcgttgtggtacaaagaagtgattcttgatgacggcattgaagactaatga

SEQ ID NO: 86 - protein, 450 aa, Artificial Sequence
  T. brockii beta-glucosidase variant
MIKLAKFPRDFVWGTATSSYQIEGAVDEDGRTPSIWDTFSKTEGKTYKGHTGDVACDHYHRYKEDVEILKEIGVKAYRFSIAWTRIFPEEGKYNPKGMDFYKKLIDELQKRDIVPAATIYHWDLPQWAFDIGGDWLNRESIKWYVEYATKLFEELGDAVPLWITHNEPWCSSILSYGIGEHAPGHKNYREALIAAHHILLSHGEAVKAFREMNIKGSKIGIALNLTPAYPASEKEEDKMAAQYADGFANRWFLDPIFKGNYPEDMMELYSKIIGEFDFIKEGDLETISVPIDFLGVNYYTRSVVKYDEDSMLKAENVPGPGKRTEMGWEVSPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTSQKRILKDSALWYKEVILDDGIED

SEQ ID NO: 87 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttgacgaagatggtcgtaccccgagtatctgggataccttctctaaaacggaggggaaaacttacaaaggtcatacaggtgatgtcgcatgtgaccattatcatcgctacaaagaggatgtcgagatcttaaaagaaattggagtaaaggcctaccgcttctcgattgcttggacgcgaattttcccagaagaaggcaaatacaatccaaaaggcatggatttttacaagaagttgatcgatgaactccagaagcacgatattgtccccgcggcgacgatttatcactgggatttaccgcagtgggcgtatgatattggcggtggctggttaaatcgtgaaagcatcaaatggtatgtagaatatgcaaccaaactttttgaggaattgggtgacgccattcctctctggatcacacataatgaaccgtggtgttcaagtattttgagctatggtattggtgagcatgcgcctggccataaaaactatcgcgaagcactcattgctgcacatcatattttgttgtcgtatggtgaagccgtgaaagcattccgggagatgaatatcaaagggtccaagattggaatcaccctcaatctcaccccagcgtatcccgccagcgagaaagaagaagataagttggcggcgcagtacgccgacggctttgctaaccgttggttcctcgacccgatcttcaaaggaaactacccggaagatatgatggagttatacagcaagatcatcggcgagtttgattttatcaaagaaggcgacttggaaacgatctctgtcccaatcgactttttaggtgttaactattatacgcgctccgtcgtcaaatacgatgaagactctatgcttaaagccgaaaacgtacctggtccgggcaaacgcaccgagatggggtgggaaatctcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatacttcgcagaaacgcatccttaaagatagtgcgttgtggtacaaagaagtgattcttgatgacggcattgaagaccagtga

SEQ ID NO: 88 - protein, 451 aa, Artificial Sequence
  T. brockii beta-glucosidase variant
MIKLAKFPRDFVWGTATSSYQIEGAVDEDGRTPSIWDTFSKTEGKTYKGHTGDVACDHYHRYKEDVEILKEIGVKAYRFSIAWTRIFPEEGKYNPKGMDFYKKLIDELQKHDIVPAATIYHWDLPQWAYDIGGGWLNRESIKWYVEYATKLFEELGDAIPLWITHNEPWCSSILSYGIGEHAPGHKNYREALIAAHHILLSYGEAVKAFREMNIKGSKIGITLNLTPAYPASEKEEDKLAAQYADGFANRWFLDPIFKGNYPEDMMELYSKIIGEFDFIKEGDLETISVPIDFLGVNYYTRSVVKYDEDSMLKAENVPGPGKRTEMGWEISPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTSQKRILKDSALWYKEVILDDGIEDQ

SEQ ID NO: 89 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttgacgaagatggtcgtaccccgagtatctgggataccttctctaaaacggaggggaaaacttacaaaggtcatacaggtgatgtcgcatgtgaccattatcatcgctacaaagaggatgtcgagatcttaaaagaaattggagtaaaggcctaccgcttctcgattgcttggccacgtattttcccagaagaaggcaaatacaatccaaaaggcatggatttttacaagaagttgatcgatgaactccagaagcgcgatattgtccccgcggcgacgatttatcactgggatttaccgcagtgggcgtacgatataggcggtggctggttaaatcgtgaaagcatcaaatggtatgtagaatatgcaaccaaactttttgaggaattgggtgacgccgtacctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgtatcccgccagcgagaaagaagaagataagatggcggcgcagtacgccgacggctttgctaaccgttggttcctcgacccgatcttcaaaggaaactacccggaagatatgatggagttatacagcaagatcatcggcgagtttgattttatcaaagaaggcgacttggaaacgatctctgtcccaatcgactttttaggtgttaactattatacgcgctccatcgtcaaatacgctgaagactctatgcttaaagccgaaaacgtacctggtccgggcaaacgcaccgagatggggtgggaagtttcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatacttcgcagaaacgcatccttaaagatagtgcgttgtggtacaaagaagtgattcttgatgacggcattgaagaccagtga

SEQ ID NO: 90 - protein, 451 aa, Artificial Sequence
  T. brockii beta-glucosidase variant
MIKLAKFPRDFVWGTATSSYQIEGAVDEDGRTPSIWDTFSKTEGKTYKGHTGDVACDHYHRYKEDVEILKEIGVKAYRFSIAWPRIFPEEGKYNPKGMDFYKKLIDELQKRDIVPAATIYHWDLPQWAYDIGGGWLNRESIKWYVEYATKLFEELGDAVPLWITHNEPWCSSILSYGIGEHAPGHKNYREALIAAHHILLSHGEAVKAFREMNIKGSKIGITLNLTPAYPASEKEEDKMAAQYADGFANRWFLDPIFKGNYPEDMMELYSKIIGEFDFIKEGDLETISVPIDFLGVNYYTRSIVKYAEDSMLKAENVPGPGKRTEMGWEVSPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTSQKRILKDSALWYKEVILDDGIEDQ

SEQ ID NO: 91 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttaatgaagatggtcgtaccccgagtatctgggataccttctctaaaacggaggggaaaacttacaaaggtcatacaggtgatgtcgcatgtgaccattatcatcgctacaaagaggatgtcgagatcttaaaagaaattggagtaaaggcctaccgcttctcgattgcttggacgcgtattttcccagaagaaggcaaatacaatccaaaaggcatggatttttacaagaagttgatcgatgaactccagaagcgcgatattgtccccgcggcgacgatttatcactgggatttaccgcagtgggcgtttgatattggcggtgactggttaaatcgtgaaagcatcaaatggtatgtagaatatgcaaccaaactttttgaggaattgggtgacgccattcctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgtatcccgccagcgagaaagaagaagataagatggcggcgcagtacgccgacggctttgctaaccgttggttcctcgacccgatcttcaaaggaaactacccggaagatatgatggagttatacagcaagatcatcggcgagtttgattttatcaaagaaggcgacttggaaacgatctctgtcccaatcgactttttaggtgttaactattatacgcgctccgtcgtcaaatacgctgaagactctatgcttaaagccgaaaacgtacctggtccgggcaaacgcaccgagatggggtgggaagtttcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatactacccagaaacgcatccttaaagatagtgcgttgtggtacaaagaagtgattcttgatgacggcattgaagaccagtga

SEQ ID NO: 92 - protein, 451 aa, Artificial Sequence
  T. brockii beta-glucosidase variant
MIKLAKFPRDFVWGTATSSYQIEGAVNEDGRTPSIWDTFSKTEGKTYKGHTGDVACDHYHRYKEDVEILKEIGVKAYRFSIAWTRIFPEEGKYNPKGMDFYKKLIDELQKRDIVPAATIYHWDLPQWAFDIGGDWLNRESIKWYVEYATKLFEELGDAIPLWITHNEPWCSSILSYGIGEHAPGHKNYREALIAAHHILLSHGEAVKAFREMNIKGSKIGITLNLTPAYPASEKEEDKMAAQYADGFANRWFLDPIFKGNYPEDMMELYSKIIGEFDFIKEGDLETISVPIDFLGVNYYTRSVVKYAEDSMLKAENVPGPGKRTEMGWEVSPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTTQKRILKDSALWYKEVILDDGIEDQ

SEQ ID NO: 93 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttgacgaagatggtcgtaccccgagtatctgggataccttctctaaaacggaggggaaaacttacaaaggtcatacaggtgatgtcgcatgtgaccattatcatcgctacaaaaaggatgtcgagatcttaaaagaaattggagtaaaggcctaccgcttctcgattgcttggacgcgtattttcccagaagaaggcaaatacaatccaaaaggcatggatttttacaagaagttgatcgatgaactccagaagcgcgatattgtccccgcggcgacgatttatcactgggatttaccgcagtgggcgtttgatattggcggtgactggttaaatcgtgaaagcatcaaatggtatgtagaatatgcaaccaaactttttgaggaattgggtgacgccgtacctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgtatcccgccagcgagaaagaagaagataagttggcggcgcagtacgccgacggctttgctaaccgttggttcctcgacccgatctccaaaggaaactacccggaagatatgatggagttatacagcaagatcatcggcgagtttgattttatcaaagaaggcgacttggaaacgatctctgtcccaatcgactttttaggtgttaactattatacgcgctccgtcgtcaaatacgatgaagactctatgcttaaagccgaaaacgtacctggtccgggcaaacgcaccgagatggggtgggaaatctcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatacttcgcagaaacgcatccttaaagatagtgcgttgtggtacaaagaagtgattcttgatgacggcattgaagactaatga

SEQ ID NO: 94 - protein, 450 aa, Artificial Sequence
  T. brockii beta-glucosidase variant
MIKLAKFPRDFVWGTATSSYQIEGAVDEDGRTPSIWDTFSKTEGKTYKGHTGDVACDHYHRYKKDVEILKEIGVKAYRFSIAWTRIFPEEGKYNPKGMDFYKKLIDELQKRDIVPAATIYHWDLPQWAFDIGGDWLNRESIKWYVEYATKLFEELGDAVPLWITHNEPWCSSILSYGIGEHAPGHKNYREALIAAHHILLSHGEAVKAFREMNIKGSKIGITLNLTPAYPASEKEEDKLAAQYADGFANRWFLDPISKGNYPEDMMELYSKIIGEFDFIKEGDLETISVPIDFLGVNYYTRSVVKYDEDSMLKAENVPGPGKRTEMGWEISPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTSQKRILKDSALWYKEVILDDGIED

SEQ ID NO: 95 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttgacgaagatggtcgtaccccgagtatctgggataccttctctaaaacggaggggaaaacttacaaaggtcatacaggtgatgtcgcatgtgaccattatcatcgctacaaagaggatgtcgagatcttaaaagaaattggagtaaaggcctaccgcttctcgattgcttggccacgtattttcccagaagaaggcaaatacaatccaaaaggcatggatttttacaagaagttgatcgatgaactccagaagcgcgatattgtccccgcggcgacgatttatcactgggatttaccgcagtgggcgtacgatataggcggtggctggttaaatcgtgaaagcatcaaatggtatgtagaatatgcaaccaaactttttgaggaattgggtgacgccgtacctctctggatcacacataatgaaccgtggtgttcaagtattttgagctatggtattggagagcatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgtatcccgccagcgagaaagaagaagataagatggcggcgcagtacgccgacggctttgctaaccgttggttcctcgacccgatcttcaaaggaaactacccggaagatatgatggagttatacagcaagatcatcggcgagtttgattttatcaaagaaggcgacttggaaacgatctctgtcccaatcgactttttaggtgttaactattatacgcgctccgtcgtcaaatacgctgaagactctatgcttaaagccgaaaacgtacctggtccgggcaaacgcaccgagatggggtgggaaatctcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatacttcgcagaaacgcatccttaaagatagtgcgttgtggtacaaagaagtgattcttgatgacggcattgaagactaatga

SEQ ID NO: 96 - protein, 450 aa, Artificial Sequence
  T. brockii beta-glucosidase variant
MIKLAKFPRDFVWGTATSSYQIEGAVDEDGRTPSIWDTFSKTEGKTYKGHTGDVACDHYHRYKEDVEILKEIGVKAYRFSIAWPRIFPEEGKYNPKGMDFYKKLIDELQKRDIVPAATIYHWDLPQWAYDIGGGWLNRESIKWYVEYATKLFEELGDAVPLWITHNEPWCSSILSYGIGEHAPGHKNYREALIAAHHILLSHGEAVKAFREMNIKGSKIGITLNLTPAYPASEKEEDKMAAQYADGFANRWFLDPIFKGNYPEDMMELYSKIIGEFDFIKEGDLETISVPIDFLGVNYYTRSVVKYAEDSMLKAENVPGPGKRTEMGWEISPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTSQKRILKDSALWYKEVILDDGIED

SEQ ID NO: 97 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttgacgaagatggtcgtaccccgagtatctgggataccttctctaaaacggaggggaaaacttacaaaggtcatacaggtgatgtcgcatgtgaccattatcatcgctacaaaaaggatgtcgagatcttaaaagaaattggagtaaaggcctaccgcttctcgattgcttggccacgtattttcccagaagaaggcaaatacaatccaaaaggcatggatttttacaagaagttgatcgatgaactccagaagcgcgatattgtccccgcggcgacgatttatcactgggatttaccgcagtgggcgtttgatattggcggtgactggttaaatcgtgaaagcatcaaatggtatgtagaatatgcaaccaaactttttgaggaattgggtgacgccgtacctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgtatcccgccagcgagaaagaagaagataagatggcggcgcagtacgccgacggctttgctaaccgttggttcctcgacccgatcttcaaaggaaactacccggaagatatgatggagttatacagcaagatcatcggcgagtttgattttatcaaagaaggcgacttggaaacgatctctgtcccaatcgactttttaggtgttaactattatacgcgctccatcgttaaatacgctgaagactctatgcttaaagccgaaaacgtacctggtccgggcaaacgcaccgagatggggtgggaagtttcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatacttcgcagaaacgcatccttaaagatagtgcgttgtggtacaaagaagtgattcttgatgacggcattgaagaccagtga

SEQ ID NO: 98 - protein, 451 aa, Artificial Sequence
  T. brockii beta-glucosidase variant
MIKLAKFPRDFVWGTATSSYQIEGAVDEDGRTPSIWDTFSKTEGKTYKGHTGDVACDHYHRYKKDVEILKEIGVKAYRFSIAWPRIFPEEGKYNPKGMDFYKKLIDELQKRDIVPAATIYHWDLPQWAFDIGGDWLNRESIKWYVEYATKLFEELGDAVPLWITHNEPWCSSILSYGIGEHAPGHKNYREALIAAHHILLSHGEAVKAFREMNIKGSKIGITLNLTPAYPASEKEEDKMAAQYADGFANRWFLDPIFKGNYPEDMMELYSKIIGEFDFIKEGDLETISVPIDFLGVNYYTRSIVKYAEDSMLKAENVPGPGKRTEMGWEVSPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTSQKRILKDSALWYKEVILDDGIEDQ

SEQ ID NO: 99 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttgacgaagatggtcgtaccccgagtatctgggataccttctctaaaacggaggggaaaacttacaaaggtcatacaggtgatgtcgcatgtgaccattatcatcgctacaaagaggatgtcgagatcttaaaagaaattggagtaaaggcctaccgcttctcgattgcttggccacgtattttcccagaagaaggcaaatacaatccaaaaggcatggatttttacaaggagttgatcgatgaactccagaagcgcgatattgtccccgcggcgacgatttatcactgggatttaccgcagtgggcgtttgatattggcggtggctggttaaatcgtgaaagcatcaaatggtatgtagaatatgcaaccaaactttttgaggaattgggtgacgccgtacctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgcatcccgccagcgagaaagaagaagataagatggcggcgcagtacgccgacggctttgctaaccgttggttcctcgacccgatcttcaaaggaaactacccggaagatatgatggagttatacagcaagatcatcggcgagtttgattttatcaaagaaggcgacttggaaacgatctctgtcccaatcgactttttaggtgttaactattatacgcgctccgtcgtcaaatacgctgaagactctatgcttaaagccgaaaacgtacctggtccgggcaaacgcaccgagatggggtgggaagtttcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatacttcgcagaaacgcatccttaaagatagtgcgttgtggtacaaagaagtgattcttgatgacggcattgaagaccagtga

SEQ ID NO: 100 - protein, 451 aa, Artificial Sequence
  T. brockii beta-glucosidase variant
MIKLAKFPRDFVWGTATSSYQIEGAVDEDGRTPSIWDTFSKTEGKTYKGHTGDVACDHYHRYKEDVEILKEIGVKAYRFSIAWPRIFPEEGKYNPKGMDFYKELIDELQKRDIVPAATIYHWDLPQWAFDIGGGWLNRESIKWYVEYATKLFEELGDAVPLWITHNEPWCSSILSYGIGEHAPGHKNYREALIAAHHILLSHGEAVKAFREMNIKGSKIGITLNLTPAHPASEKEEDKMAAQYADGFANRWFLDPIFKGNYPEDMMELYSKIIGEFDFIKEGDLETISVPIDFLGVNYYTRSVVKYAEDSMLKAENVPGPGKRTEMGWEVSPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTSQKRILKDSALWYKEVILDDGIEDQ

SEQ ID NO: 101 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttgacgaagatggtcgtaccccgagtatctgggataccttctctaaaacggaggggaaaacttacaaaggtcatacaggtgatgtcgcatgtgaccattatcatcgctacaaaaaggatgtcgagatcttaaaagaaattggagtaaaggcctaccgcttctcgattgcttggacgcgtattttcccagaagaaggcaaatacaatccaaaaggcatggatttttacaagaagttgatcgatgaactccagaagcgcgatattgtccccgcggcgacgatttatcactgggatttaccgcagtgggcgtacgatataggcggtggctggttaaatcgtgaaagcatcaaatggtatgtagaatatgcaaccaaactttttgaggaattgggtgacgccgtacctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgtatcccgccagcgagaaagaagaagataagatggcggcgcagtacgccgacggctttgctaaccgttggttcctcgacccgatcttcaaaggaaactacccggaagatatgatggagttatacagcaagatcatcggcgagtttgattttatcaaagaaggcgacttggaaacgatctctgtcccaatcgactttttaggtgttaactattatacgcgctccatcgtcaaatacgatgaagactctatgcttaaagccgaaaacgtacctggtccgggcaaacgcaccgagatggggtgggaagtttcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatacttcgcagaaacgcatccttaaagatagtgcgttgtggtacaaagaagtgattcttgatgacggcattgaagaccagtga

SEQ ID NO: 102 - protein, 451 aa, Artificial Sequence
  T. brockii beta-glucosidase variant
MIKLAKFPRDFVWGTATSSYQIEGAVDEDGRTPSIWDTFSKTEGKTYKGHTGDVACDHYHRYKKDVEILKEIGVKAYRFSIAWTRIFPEEGKYNPKGMDFYKKLIDELQKRDIVPAATIYHWDLPQWAYDIGGGWLNRESIKWYVEYATKLFEELGDAVPLWITHNEPWCSSILSYGIGEHAPGHKNYREALIAAHHILLSHGEAVKAFREMNIKGSKIGITLNLTPAYPASEKEEDKMAAQYADGFANRWFLDPIFKGNYPEDMMELYSKIIGEFDFIKEGDLETISVPIDFLGVNYYTRSIVKYDEDSMLKAENVPGPGKRTEMGWEVSPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTSQKRILKDSALWYKEVILDDGIEDQ

SEQ ID NO: 103 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttgacgaagatggtcgtaccccgagtatctgggataccttctctaaaacggaggggaaaacttacaaaggtcatacaggtgatgtcgcatgtgaccattatcatcgctacaaagaggatgtcgagatcttaaaagaaattggagtaaaggcctaccgcttctcgattgcttggacgcgtattttcccagaagaaggcaaatacaatccaaaaggcatggatttttacaagaagttgatcgatgaactccagaagcgcgatattgtccccgcggcgacgatttatcactgggatttaccgcagtgggcgtacgatataggcggtggctggttaaatcgtgaaagcatcaaatggtatgtagaatatgcaaccaaactttttgaggaattgggtgacgccattcctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgtatcccgccagcgagaaagaagaagataagttggcggcgcagtacgccgacggctttgctaaccgttggttcctcgacccgatcttcaaaggaaactacccggaagatatgatggagttatacagcaagatcatcggcgagtttgattttatcaaagaaggcgacttggaaacgatctctgtcccaatcgactttttaggtgttaactattatacgcgctccgtcgtcaaatacgctgaagactctatgcttaaagccgaaaacgtacctggtccgggcaaacgcaccgagatggggtgggaagtttcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatacttcgcagaaacgcatccttaaagatagtgcgttgtggtacaaagaagtgattcttgatgacggcattgaagaccagtga

SEQ ID NO: 104 - protein, 451 aa, Artificial Sequence
  T. brockii beta-glucosidase variant
MIKLAKFPRDFVWGTATSSYQIEGAVDEDGRTPSIWDTFSKTEGKTYKGHTGDVACDHYHRYKEDVEILKEIGVKAYRFSIAWTRIFPEEGKYNPKGMDFYKKLIDELQKRDIVPAATIYHWDLPQWAYDIGGGWLNRESIKWYVEYATKLFEELGDAIPLWITHNEPWCSSILSYGIGEHAPGHKNYREALIAAHHILLSHGEAVKAFREMNIKGSKIGITLNLTPAYPASEKEEDKLAAQYADGFANRWFLDPIFKGNYPEDMMELYSKIIGEFDFIKEGDLETISVPIDFLGVNYYTRSVVKYAEDSMLKAENVPGPGKRTEMGWEVSPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTSQKRILKDSALWYKEVILDDGIEDQ

SEQ ID NO: 105 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttgacgaagatggtcgtaccccgagtatctgggataccttctctaaaacggaggggaaaacttacaaaggtcatacaggtgatgtcgcatgtgaccattatcatcgctacaaaaaggatgtcgagatcttaaaagaaattggagtaaaggcctaccgcttctcgattgcttggacgcgtattttcccagaagaaggcaaatacaatccaaaaggcatggatttttacaagaagttgatcgatgaactccagaagcgcgatattgtccccgcggcgacgatttatcactgggatttaccgcagtgggcgtttgatattggcggtggctggttaaatcgtgaaagcatcaaatggtatgtagaatatgcaaccaaactttttgaggaattgggtgacgccgtacctctctggatcacacataatgaaccgtggtgttcaagtattttgagctatggtattggtgagcatgcgcctggccataaaaactatcgcgaagcactcattgctgcacaccatattttgttgtcgtatggtgaaggggtgaaagcattccgggagatgaatatcaaagggtccaagattggaatcaccctcaatctcaccccagcgtatcccgccagcgagaaagaagaagataagttggcggcgcagtacgccgacggctttgctaaccgttggttcctcgacccgatcttcaaaggaaactacccggaagatatgatggagttatacagcaagatcatcggcgagtttgattttatcaaagaaggcgacttggaaacgatctctgtcccaatcgactttttaggtgttaactattatacgcgctccatcgtcaaatacgctgaagactctatgcttaaagccgaaaacgtacctggtccgggcaaacgcaccgagatggggtgggaaatctcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatactacccagaaacgcatccttaaagatagtgcgttgtggtacaaagaagtgattcttgatgacggcattgaagaccagtga

SEQ ID NO: 106 - protein, 451 aa, Artificial Sequence
  T. brockii beta-glucosidase variant
MIKLAKFPRDFVWGTATSSYQIEGAVDEDGRTPSIWDTFSKTEGKTYKGHTGDVACDHYHRYKKDVEILKEIGVKAYRFSIAWTRIFPEEGKYNPKGMDFYKKLIDELQKRDIVPAATIYHWDLPQWAFDIGGGWLNRESIKWYVEYATKLFEELGDAVPLWITHNEPWCSSILSYGIGEHAPGHKNYREALIAAHHILLSYGEGVKAFREMNIKGSKIGITLNLTPAYPASEKEEDKLAAQYADGFANRWFLDPIFKGNYPEDMMELYSKIIGEFDFIKEGDLETISVPIDFLGVNYYTRSIVKYAEDSMLKAENVPGPGKRTEMGWEISPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTTQKRILKDSALWYKEVILDDGIEDQ

SEQ ID NO: 107 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttgacgaagatggtcgtaccccgagtatctgggataccttctctaaaacggaggggaaaacttacaaaggtcatacaggtgatgtcgcatgtgaccattatcatcgctacaaagaggatgtcgagatcttaaaagaaattggagtaaaggcctaccgcttctcgattgcttggccacgtattttcccagaagaaggcaaatacaatccaaaaggcatggatttttacaagaagttgatcgatgaactccagaagcgcgatattgtccccgcggcgacgatttatcactgggatttaccgcagtgggcgtttgatattggcggtggctggttaaatcgtgaaagcatcaaatggtatgtagaatatgcaaccaaactttttgaggaattgggtgacgccgtacctctctggatcacacataatgaaccgtggtgttcaagtattttgagctatggtattggtgagcatgcgcctggccataaaaactatcgcgaagcactcattgctgcacatcatattttgttgtcgtatggtgaagccgtgaaagcattccgggagatgaatatcaaagggtccaagattggaatcaccctcaatctcaccccagcgtatcccgccagcgagaaagaagaagataagatggcggcgcagtacgccgacggctttgctaaccgttggttcctcgacccaatcttcaaaggaaactacccggaagatatgatggagttatacagcaagatcatcggcgagtttgattttatcaaagaaggcgacttggaaacgatctctgtcccaatcgactttttaggtgttaactattatacgcgctccgtcgtcaaatacgctgaagactctatgcttaaggccgaaaacgtacctggtccgggcaaacgcaccgagatggggtgggaagtttcgccggagtcattatatgaccttcttaagcggctcgaccgcgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatacttcgcagaaacgcatccttaaagatagtgcgttgtggtacaaagaagtgattcttgatgacggcattgaagaccagtga

SEQ ID NO: 108 - protein, 451 aa, Artificial Sequence
  T. brockii beta-glucosidase variant
MIKLAKFPRDFVWGTATSSYQIEGAVDEDGRTPSIWDTFSKTEGKTYKGHTGDVACDHYHRYKEDVEILKEIGVKAYRFSIAWPRIFPEEGKYNPKGMDFYKKLIDELQKRDIVPAATIYHWDLPQWAFDIGGGWLNRESIKWYVEYATKLFEELGDAVPLWITHNEPWCSSILSYGIGEHAPGHKNYREALIAAHHILLSYGEAVKAFREMNIKGSKIGITLNLTPAYPASEKEEDKMAAQYADGFANRWFLDPIFKGNYPEDMMELYSKIIGEFDFIKEGDLETISVPIDFLGVNYYTRSVVKYAEDSMLKAENVPGPGKRTEMGWEVSPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTSQKRILKDSALWYKEVILDDGIEDQ

SEQ ID NO: 109 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttaatgaagatggtcgtaccccgagtatctgggataccttctctaaaacggaggggaaaacttacaaaggtcatacaggtgatgtcgcatgtgaccattatcatcgctacaaagaggatgtcgagatcttaaaagaaattggagtaaaggcctaccgcttctcgattgcttggacgcgtattttcccagaagaaggcaaatacaatccaaaaggcatggatttttacaagaagttgatcgatgaactccagaagcgcgatattgtccccgcggcgacgatttatcactgggatttaccgcagtgggcgtacgatataggcggtggctggttaaatcgtgaaagcatcaaatggtatgtagaatatgcaaccaaactttttgaggaattgggtgacgccgtacctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgtatcccgccagcgagaaagaagaagataagttggcggcgcagtacgccgacggctttgctaaccgttggttcctcgacccgatcttcaaaggaaactacccggaagatatgatggagttatacagcaagatcatcggcgagtttgattttatcaaagaaggcgacttggaaacgatctctgtcccaatcgactttttaggtgttaactattatacgcgctccgtcgtcaaatacgctgaagactctatgcttaaagccgaaaacgtacctggtccgggcaaacgcaccgagatggggtgggaagtttcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatacttcgcagaaacgcatccttaaagatagtgcgttgtggtacaaagaagtgattcttgatgacggcattgaagaccagtga

SEQ ID NO: 110 - protein, 451 aa, Artificial Sequence
  T. brockii beta-glucosidase variant
MIKLAKFPRDFVWGTATSSYQIEGAVNEDGRTPSIWDTFSKTEGKTYKGHTGDVACDHYHRYKEDVEILKEIGVKAYRFSIAWTRIFPEEGKYNPKGMDFYKKLIDELQKRDIVPAATIYHWDLPQWAYDIGGGWLNRESIKWYVEYATKLFEELGDAVPLWITHNEPWCSSILSYGIGEHAPGHKNYREALIAAHHILLSHGEAVKAFREMNIKGSKIGITLNLTPAYPASEKEEDKLAAQYADGFANRWFLDPIFKGNYPEDMMELYSKIIGEFDFIKEGDLETISVPIDFLGVNYYTRSVVKYAEDSMLKAENVPGPGKRTEMGWEVSPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTSQKRILKDSALWYKEVILDDGIEDQ

SEQ ID NO: 111 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttgacgaagatggtcgtaccccgagtatctgggataccttctctaaaacggaggggaaaacttacaaaggtcatacaggtgatgtcgcatgtgaccattatcatcgctacaaagaggatgtcgagatcttaaaagaaattggagtaaaggcctaccgcttctcgattgcttggacgcgtattttcccagaagaaggcaaatacaatccaaaaggcatggatttttacaagaagttgatcgatgaactccagaagcgcgatattgtccccgcggcgacgatttatcactgggatttaccgcagtgggcgtacgatataggcggtggctggttaaatcgtgaaagcatcaaatggtatgtagaatatgcaaccaaactttttgaggaattgggtgacgccgtacctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgtatcccgccagcgagaaagaagaagataagttggcggcgcagtacgccgacggctttgctaaccgttggttcctcgacccgatcttcaaaggaaactacccggaagatatgatggagttatacagcaagatcatcggcgagtttgattttatcaaagaaggcgacttggaaacgatctctgtcccaatcgactttttaggtgttaactattatacgcgctccgtcgtcaaatacgctgaagactctatgcttaaagccgaaaacgtacctggtccgggcaaacgcaccgagatggggtgggaagtttcgccggagccattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatacttcgcagaaacgcatccttaaagatagtgcgttgtggtacaaagaagtgattcttgatgacggcattgaagaccagtga

SEQ ID NO: 112 - protein, 451 aa, Artificial Sequence
  T. brockii beta-glucosidase variant
MIKLAKFPRDFVWGTATSSYQIEGAVDEDGRTPSIWDTFSKTEGKTYKGHTGDVACDHYHRYKEDVEILKEIGVKAYRFSIAWTRIFPEEGKYNPKGMDFYKKLIDELQKRDIVPAATIYHWDLPQWAYDIGGGWLNRESIKWYVEYATKLFEELGDAVPLWITHNEPWCSSILSYGIGEHAPGHKNYREALIAAHHILLSHGEAVKAFREMNIKGSKIGITLNLTPAYPASEKEEDKLAAQYADGFANRWFLDPIFKGNYPEDMMELYSKIIGEFDFIKEGDLETISVPIDFLGVNYYTRSVVKYAEDSMLKAENVPGPGKRTEMGWEVSPEPLYDLLKRLDREYTKLPMYITENGAAFKDEVTEDGRVHDDERIEYIKEHLKAAAKFIGEGGNLKGYFVWSLMDNFEWAHGYSKRFGIVYVDYTSQKRILKDSALWYKEVILDDGIEDQ

SEQ ID NO: 113 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttgacgaagatggtcgtaccccgagtatctgggataccttctctaaaacggaggggaaaacttacaaaggtcatacaggtgatgtcgcatgtgaccattatcatcgctacaaagaggatgtcgagatcttaaaagaaattggagtaaaggcctaccgcttctcgattgcttggacgcgtattttcccagaagaaggcaaatacaatccaaaaggcatggatttttacaagaagttgatcgatgaactccagaagcgcgatattgtccccgcggcgacgatttatcactgggatttaccgcagtgggcgtatgataaaggcggtgactggttaaatcgtgaaagcatcaaatggtatgtagaatatgcaaccaaactttttgaggaattgggtgacgccgtacctctctggatcacacataatgaaccgtggtgttcaagtattttgagctatggtattggtgagcatgcgcctggccataaaaactatcgcgaagcactcattgctgcacaccatattttgttgtcgtatggtgaagccgtgaaagcattccgggagatgaatatcaaagggtccaagattggaatcaccctcaatctcaccccagcgtatcccgccagcgagaaagaagaagataagatggcggcgcagtacgccgacggctttgctaaccgttggttcctcgacccgatcttcaaaggaaactacccggaagatatgatggagttatacagcaagatcatcggcgagtttgattttatcaaagaaggcgacttggaaacgatctctgtcccaatcgactttttaggtgttaactattatacgcgctccgtcgtcaaatacgctgaagactctatgcttaaagccgaaaacgtacctggtccgggcaaacgcaccgagatggggtgggaagtttcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatacttcgcagaaacgcatccttaaagatagtgcgttgtggtacaaagaagtgattcttgatgacggcattgaagaccagtga

SEQ ID NO: 114 - protein, 451 aa, Artificial Sequence
  T. brockii beta-glucosidase variant
MIKLAKFPRDFVWGTATSSYQIEGAVDEDGRTPSIWDTFSKTEGKTYKGHTGDVACDHYHRYKEDVEILKEIGVKAYRFSIAWTRIFPEEGKYNPKGMDFYKKLIDELQKRDIVPAATIYHWDLPQWAYDKGGDWLNRESIKWYVEYATKLFEELGDAVPLWITHNEPWCSSILSYGIGEHAPGHKNYREALIAAHHILLSYGEAVKAFREMNIKGSKIGITLNLTPAYPASEKEEDKMAAQYADGFANRWFLDPIFKGNYPEDMMELYSKIIGEFDFIKEGDLETISVPIDFLGVNYYTRSVVKYAEDSMLKAENVPGPGKRTEMGWEVSPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTSQKRILKDSALWYKEVILDDGIEDQ

SEQ ID NO: 115 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttgacgaagatggtcgtaccccgagtatctgggataccttctctaaaacggaggggaaaacttacaaaggtcatacaggtgatgtcgcatgtgaccattatcatcgctacaaagaggatgtcgagatcttaaaagaaattggagtaaaggcctaccgcttctcgattgcttggacgcgtattttcccagaagaaggcaaatacaatccaaaaggcatggatttttacaagaagttgatcgatgaactccagaagcgcgatattgtccccgcggcgacgatttatcactgggatttaccgcagtgggcgtttgataaaggcggtggctggttaaatcgtgaaagcatcaaatggtatgtagaatatgcaaccaaactttttgaggaattgggtgacgccgtacctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgtatcccgccagcgagaaagaagaagataagatggcggcgcagtacgccgacggctttgctaaccgttggttcctcgacccgatcttcaaaggaaactacccggaagatatgatggagttatacagcaagatcatcggcgagtttgattttatcaaagaaggcgacttggaaacgatctctgtcccaatcgactttttaggtgttaactattatacgcgctccgtcgtcaaatacgctgaagactctatgcttaaagccgaaaacgtacctggtccgggcaaacgcaccgagatggggttggaaatctcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatactacccagaaacgcatccttaaagatagtgcgttgtggtacaaagaagtgattcttgatgacggcattgaagaccagtga

SEQ ID NO: 116 - protein, 451 aa, Artificial Sequence
  T. brockii beta-glucosidase variant
MIKLAKFPRDFVWGTATSSYQIEGAVDEDGRTPSIWDTFSKTEGKTYKGHTGDVACDHYHRYKEDVEILKEIGVKAYRFSIAWTRIFPEEGKYNPKGMDFYKKLIDELQKRDIVPAATIYHWDLPQWAFDKGGGWLNRESIKWYVEYATKLFEELGDAVPLWITHNEPWCSSILSYGIGEHAPGHKNYREALIAAHHILLSHGEAVKAFREMNIKGSKIGITLNLTPAYPASEKEEDKMAAQYADGFANRWFLDPIFKGNYPEDMMELYSKIIGEFDFIKEGDLETISVPIDFLGVNYYTRSVVKYAEDSMLKAENVPGPGKRTEMGLEISPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTTQKRILKDSALWYKEVILDDGIEDQ

SEQ ID NO: 117 - DNA, 1356 bp, Artificial Sequence
  CDS (1)..(1356): T. brockii beta-glucosidase variant
atgattaaattagccaagtttccgcgtgatttagtgtggggaacggcgacatccagttatcaaatcgaaggggctgttgacgaagatggtcgtaccccgagtatctgggataccttctctaaaacggaggggaaaacttacaaaggtcatacaggtgatgtcgcatgtgaccattatcatcgctacaaagaggatgtcgagatcttaaaagaaattggagtaaaggcctaccgcttctcgattgcttggacgcgtattttcccagaagaaggcaaatacaatccaaaaggcatggatttttacaagaagttgatcgatgaactccagaagcgcgatattgtccccgcggcgacgatttatcactgggatttaccgcagtgggcgtttgataaaggcggtggctggttaaatcgtgaaagcatcaaatggtatgtagaatatgcaaccaaactttttgaggaattgggtgacgccgtacctctctggatcacacataatgaaccgtggtgttcaagtattttgagctatggtattggtgagcatgcgcctggccataaaaactatcgcgaagcactcattgctgcacaccatattttgttgtcgcacggtgaaggcgtgaaagcattccgggagatgaatatcaaagggtccaagattggaatcaccctcaatctcaccccagcgtatcccgccagcgagaaagaagaagataagatggcgacgcagtacgccgacggctttgctaaccgttggttcctcgacccgatcttcaaaggaaactacccggaagatatgatggagttatacagcaagatcatcggcgagtttgattttatcaaagaaggcgacttggaaacgatctctgtcccaatcgactttttaggtgttaactattatacgcgctccgtcgtcaaatacgctgaagactctatgcttaaagccgaaaacgtacctggtccgggcaaacgcaccgagatggggtgggaagtctcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatacttcgcagaaacgcatccttaaagatagtgcgttgtggtacaaagaagcgattcttgatgacggcattgaagacccttga

SEQ ID NO: 118 - protein, 451 aa, Artificial Sequence
  T. brockii beta-glucosidase variant
MIKLAKFPRDLVWGTATSSYQIEGAVDEDGRTPSIWDTFSKTEGKTYKGHTGDVACDHYHRYKEDVEILKEIGVKAYRFSIAWTRIFPEEGKYNPKGMDFYKKLIDELQKRDIVPAATIYHWDLPQWAFDKGGGWLNRESIKWYVEYATKLFEELGDAVPLWITHNEPWCSSILSYGIGEHAPGHKNYREALIAAHHILLSHGEGVKAFREMNIKGSKIGITLNLTPAYPASEKEEDKMATQYADGFANRWFLDPIFKGNYPEDMMELYSKIIGEFDFIKEGDLETISVPIDFLGVNYYTRSVVKYAEDSMLKAENVPGPGKRTEMGWEVSPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTSQKRILKDSALWYKEAILDDGIEDP

SEQ ID NO: 119 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttgacgaagatggtcgtaccccgagtatctgggataccttctctaaaacggaggggaaaacttacaaaggtcatacaggtgatgtcgcatgtgaccattatcatcgctacaaagaggatgtcgagatcttaaaagaaattggagtaaaggcctaccgcttctcgattgcttggacgcgtattttcccagaagaaggcaaatacaatccaaaaggcatggatttttacaagaagttgatcgatgaactccagaagcgcgatattgtccccgcggcgacgatttatcactgggatttaccgcagtgggcgtacgatataggcggtgactggttaaatcgtgaaagcatcaaatggtatgtagaatatgcaaccaaactttttgaggaattgggtgacgccattcctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgtatcccgccagcgagaaagaagaagataagttggcggcgcagtacgccgacggctttgctaaccgttggttcctcgacccgatcttcaaaggaaactacccggaagatatgatggagttatacagcaagatcatcggcgagtttgattttatcaaagaaggcgacttggaaacgatctctgtcccaatcgactttttaggtgttaactattatacgcgctccatcgtcaaatacgctgaagactctatgcttaaagccgaaaacgtacctggtccgggcaaacgcaccgagatggggtgggaagtttcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatactacccagaaacgcatccttaaagatagtgcgttgtggtacaaagaagtgattcttgatgacggcattgaagaccagtga

SEQ ID NO: 120 - protein, 451 aa, Artificial Sequence
  T. brockii beta-glucosidase variant
MIKLAKFPRDFVWGTATSSYQIEGAVDEDGRTPSIWDTFSKTEGKTYKGHTGDVACDHYHRYKEDVEILKEIGVKAYRFSIAWTRIFPEEGKYNPKGMDFYKKLIDELQKRDIVPAATIYHWDLPQWAYDIGGDWLNRESIKWYVEYATKLFEELGDAIPLWITHNEPWCSSILSYGIGEHAPGHKNYREALIAAHHILLSHGEAVKAFREMNIKGSKIGITLNLTPAYPASEKEEDKLAAQYADGFANRWFLDPIFKGNYPEDMMELYSKIIGEFDFIKEGDLETISVPIDFLGVNYYTRSIVKYAEDSMLKAENVPGPGKRTEMGWEVSPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTTQKRILKDSALWYKEVILDDGIEDQ

SEQ ID NO: 121 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttgacgaagatggtcgtaccccgagtatctgggataccttctctaaaacggaggggaaaacttacaaaggtcatacaggtgatgtcgcatgtgaccattatcatcgctacaaagaggatgtcgagatcttaaaagaaattggagtaaaggcctaccgcttctcgattgcttggacgcgtattttcccagaagaaggcaaatacaatccaaaaggcatggatttttacaagaagttgatcgatgaactccagaagcgcgatattgtccccgcggcgacgatttatcactgggatttaccgcagtgggcgtatgataaaggcggtggctggttaaatcgtgaaagcatcaaatggtatgtagaatatgcaaccaaactttttgaggaattgggtgacgccattcctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgtatcccgccagcgagaaagaagaagataagttggcggcgcagtacgccgacggctttgctaaccgttggttcctcgacccgatcttcaaaggaaactacccggaagatatgatggagttatacagcaagatcatcggcgagtttgattttatcaaagaaggcgacttggaaacgatctctgtcccaatcgactttttaggtgttaactattatacgcgctccgtcgtcaaatacgatgaagactctatgcttaaagccgaaaacgtacctggtccgggcaaacgcaccgagatggggtgggaagtttcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcacacgggtattccaaacgttttggcattgtttatgtagattatacttcgcagaaacgcatccttaaagatagtgcgttgtggtacaaagaagtgattcttgatgacggcattgaagaccagtga

SEQ ID NO: 122 - protein, 451 aa, Artificial Sequence
  T. brockii beta-glucosidase variant
MIKLAKFPRDFVWGTATSSYQIEGAVDEDGRTPSIWDTFSKTEGKTYKGHTGDVACDHYHRYKEDVEILKEIGVKAYRFSIAWTRIFPEEGKYNPKGMDFYKKLIDELQKRDIVPAATIYHWDLPQWAYDKGGGWLNRESIKWYVEYATKLFEELGDAIPLWITHNEPWCSSILSYGIGEHAPGHKNYREALIAAHHILLSHGEAVKAFREMNIKGSKIGITLNLTPAYPASEKEEDKLAAQYADGFANRWFLDPIFKGNYPEDMMELYSKIIGEFDFIKEGDLETISVPIDFLGVNYYTRSVVKYDEDSMLKAENVPGPGKRTEMGWEVSPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTSQKRILKDSALWYKEVILDDGIEDQ

SEQ ID NO: 123 - DNA, 1356 bp, Artificial Sequence
  CDS (1)..(1356): T. brockii beta-glucosidase variant
atgattaaattagccaagtttccgcgtgattttgtgtggggaacggcgacatccagttatcaaatcgaaggggctgttaatgaagatggtcgtaccccgagtatctgggataccttctctaaaacggaggggaaaacttacaacggtcatacaggtgatgtcgcatgtgaccattatcatcgctacaaagaggatgtcgagatcttaaaagaaattggagtaaaggcctaccgcttctcgattccgtggccacgtattttcccagaagaaggcaaatacaatccaaaaggcatggatttttacaagaagttgatcgatgaactccagaagcgcgatattgtccccgcggcgacgatttatcactgggatttaccgcagtgggcgtacgatataggcggtggctggttaaatcgtgaaagcatcaaatggtatgtagaatatgcaaccaaactttttgaggaattgggtgacgtgattcctctctggatcacacataatgaaccgtggtgttcaagtattttgagctatggtattggtgagcatgcgcctggccataaaaactatcgcgaagcactcattgctgcacaccatattttgttgtcgcacggtgaagccgtgaaagcattccgggagatgaatatcaaagggtccaagattggaatcaccctcaatctcaccccagcgtatcccgccagcgagaaagaagaagataagttggcggcgcagtacgccgacggctttgctaaccgttggttcctcgacccgatcttcaaaggaaactacccggaagatatgatggagttatacagcaagatcatcggcgagtttgattttatcaaagaaggcgacttgggtacgatctctgtcccaatcgactttttaggtgttaactattatacgcgctccgttgtcaaatacgacgaagactctatgcttaaagccgaaaacgtacctggtccgggcaaacgcaccgagatggggtgggaagtttcgccggagtcattatatgaccttcttaagcggctcgaccgtgagtataccaaattacctatgtacattactgaaaacggcgctgcattcaaagacgaagttactgaagatgggcgcgttcacgatgatgagcgtattgaatacatcaaagagcaccttaaggcggccgctaaattcattggagaaggtggcaaccttaaaggttacttcgtgtggtcattgatggataattttgaatgggcagtcgggtattccaaacgttttggcattgtttatgtagattatactacccagaaacgcatccttaaagatagtgcgttgtggtacaaagaagtgattcttgatgacggcattgaagactaatga

SEQ ID NO: 124 - protein, 450 aa, Artificial Sequence
  T. brockii beta-glucosidase variant
MIKLAKFPRDFVWGTATSSYQIEGAVNEDGRTPSIWDTFSKTEGKTYNGHTGDVACDHYHRYKEDVEILKEIGVKAYRFSIPWPRIFPEEGKYNPKGMDFYKKLIDELQKRDIVPAATIYHWDLPQWAYDIGGGWLNRESIKWYVEYATKLFEELGDVIPLWITHNEPWCSSILSYGIGEHAPGHKNYREALIAAHHILLSHGEAVKAFREMNIKGSKIGITLNLTPAYPASEKEEDKLAAQYADGFANRWFLDPIFKGNYPEDMMELYSKIIGEFDFIKEGDLGTISVPIDFLGVNYYTRSVVKYDEDSMLKAENVPGPGKRTEMGWEVSPESLYDLLKRLDREYTKLPMYITENGAAFKDEVTEDGRVHDDERIEYIKEHLKAAAKFIGEGGNLKGYFVWSLMDNFEWAVGYSKRFGIVYVDYTTQKRILKDSALWYKEVILDDGIED

What is claimed is:

1. An isolated *Thermoanaerobacter brockii* β-glucosidase polypeptide variant comprising an amino acid sequence that has at least about 95% sequence identity to wild *Thermoanaerobacter brockii* β-glucosidase comprising the amino acid sequence of SEQ ID NO: 2 and having at least one substitution of an amino acid residue at a position selected from the group consisting of F11, N27, S34, Y47, K48, E64, I81, A82, P84, K103, R111, Y129, K131, G134, K142, K150, E153, A158, I159, H202, A205, K215, I221, T222, Y229, A231, L239, A241, D254, I256, F257, E285, C74, I291, I303, D307, W328, I330, S334, M351, Y352, L383, F389, K397, H412, T427, K429, V442, D445, and D446, wherein said amino acid residue is determined by alignment with SEQ ID NO: 2.

2. The isolated *Thermoanaerobacter brockii* β-glucosidase polypeptide variant of claim 1, wherein the amino acid sequence comprises at least one substitution selected from the group consisting of N27, E64, P84, Y129, K131, K215, L239, I303, D307, W328, I330, and T427, wherein said amino acid residue is determined by alignment with SEQ ID NO: 2.

3. The isolated *Thermoanaerobacter brockii* β-glucosidase polypeptide variant of claim 2, wherein the substitution is selected from the group consisting of N27D, E64V, P84T, Y129F, K131I, K215E, L239M, I303V, D307A, W238L, I330V, and T427S.

4. The isolated *Thermoanaerobacter brockii* β-glucosidase polypeptide variant of claim 3, wherein the substitution is selected from the group consisting of N27D, Y129F, L239M, and/or D307A.

5. The isolated *Thermoanaerobacter brockii* β-glucosidase polypeptide variant of claim 2, wherein the substitution is selected from the group consisting of P84T, E64I/K/V, I330V, and K215E.

6. The isolated *Thermoanaerobacter brockii* β-glucosidase polypeptide variant of claim 1, wherein the polypeptide exhibits at least 2-fold greater β-glucosidase activity than wild type *Thermoanaerobacter brockii* β-glucosidase comprising the amino acid sequence of SEQ ID NO: 2, as measured in a high throughput assay.

7. The isolated *Thermoanaerobacter brockii* β-glucosidase polypeptide variant of claim 1, wherein the polypeptide exhibits greater resistant to inhibition by glucose than wild type *Thermoanaerobacter brockii* β-glucosidase comprising the amino acid sequence of SEQ ID NO: 2, as measured in a high throughput assay.

8. An enzyme composition comprising a *Thermoanaerobacter brockii* β-glucosidase polypeptide variant according to claim 1.

9. The composition of claim 8 further comprising one or more additional cellulase enzymes.

10. The composition of claim 8, wherein said composition is used for cellulose hydrolysis.

11. The composition of claim 9, wherein said composition is used for cellulose hydrolysis.

12. An isolated *Thermoanaerobacter brockii* β-glucosidase polypeptide variant of claim 1, wherein the amino acid sequence has at least 95% sequence identity to wild type *Thermoanaerobacter brockii* β-glucosidase comprising the amino acid sequence of SEQ ID NO: 2 and comprises at least one substitution selected from the group consisting of F11L, N27D, S34G, Y47H, K48N, E64V, E64K, I81V, A82P, P84T, K103E, R111H, Y129F, K131I, G134D, K142E, K150R, E153G, A158V, I159V, H202Y, A205V/G, K215E, I221V, T222A, Y229H, A231T, L239M, A241T, D254G, I256V, F257S, E285G, T286A, I291N, I303V, D307A, W328L, I330V, S334P, M351L, Y352H, L383H, F389I, K397N, H412W/L/F/V, T427S, K429N, V442A, D445E, and D446E, wherein said amino acid residue amino acid position is determined by alignment with SEQ ID NO: 2.

* * * * *